US008796216B2

(12) United States Patent
Johnstone et al.

(10) Patent No.: US 8,796,216 B2
(45) Date of Patent: Aug. 5, 2014

(54) SUPPRESSION OF NEUROENDOCRINE DISEASES

(75) Inventors: Stephen Johnstone, Abingdon (GB); Philip Marks, Abingdon (GB); Keith Foster, Abingdon (GB)

(73) Assignee: Syntaxin Limited, Abingdon, Oxfordshire (GB)

( * ) Notice: Subject to any disclaimer, the term of this patent is extended or adjusted under 35 U.S.C. 154(b) by 493 days.

(21) Appl. No.: 12/969,810

(22) Filed: Dec. 16, 2010

(65) Prior Publication Data

US 2011/0160135 A1 Jun. 30, 2011

Related U.S. Application Data

(63) Continuation-in-part of application No. 12/996,643, filed as application No. PCT/GB2009/050665 on Jun. 11, 2009.

(30) Foreign Application Priority Data

| | | |
|---|---|---|
| Jun. 12, 2008 | (GB) | 0810782.3 |
| Jun. 12, 2008 | (GB) | 0810785.6 |
| Nov. 14, 2008 | (GB) | 0820884.5 |
| Nov. 17, 2008 | (GB) | 0820965.2 |

(51) Int. Cl.
*A61K 38/16* (2006.01)
*C07K 14/33* (2006.01)
*C12P 21/00* (2006.01)

(52) U.S. Cl.
USPC ......... 514/18.1; 514/18.2; 514/2.1; 514/17.7; 514/21.2; 435/68.1; 435/71.3; 530/350; 530/402; 536/23.1

(58) Field of Classification Search
None
See application file for complete search history.

(56) References Cited

U.S. PATENT DOCUMENTS

| | | | | |
|---|---|---|---|---|
| 2005/0031648 | A1 | 2/2005 | Brin et al. | |
| 2006/0211619 | A1 | 9/2006 | Steward et al. | |
| 2008/0032931 | A1* | 2/2008 | Steward et al. | 514/12 |

FOREIGN PATENT DOCUMENTS

| | | | |
|---|---|---|---|
| CN | 101031317 | A | 9/2007 |
| JP | H09500867 | A | 1/1997 |
| JP | H11504006 | A | 4/1999 |
| JP | 2003507073 | A | 2/2003 |
| JP | 2003509476 | A | 3/2003 |
| JP | 2004513895 | A | 5/2004 |
| JP | 2004525922 | A | 8/2004 |
| JP | 2011523859 | A | 8/2011 |
| WO | 94/21300 | A2 | 9/1994 |
| WO | 96/33273 | A1 | 10/1996 |
| WO | 9742223 | A1 | 11/1997 |
| WO | 01/14570 | A1 | 3/2001 |
| WO | 01/21213 | A2 | 3/2001 |
| WO | 0153336 | A1 | 7/2001 |
| WO | 02/34286 | A1 | 5/2002 |
| WO | 02/074327 | A2 | 9/2002 |
| WO | 2004076634 | A2 | 9/2004 |
| WO | 2005016953 | A2 | 2/2005 |
| WO | 2005023309 | A1 | 3/2005 |
| WO | 2006025976 | A1 | 3/2006 |
| WO | 2006026780 | A1 | 3/2006 |
| WO | 2006/059113 | A2 | 6/2006 |
| WO | 2006059093 | A2 | 6/2006 |
| WO | 2006099590 | A2 | 9/2006 |
| WO | 2007106115 | A1 | 9/2007 |
| WO | 2008008803 | A2 | 1/2008 |
| WO | 2009/150470 | A2 | 12/2009 |

OTHER PUBLICATIONS van den Oord et al., Umami peptides: assessment of their alleged taste properties. Z Lebensm Unters Forsch A (1997) 205: 125-130.*
Jacobsson, et al. "Botulinum neurotoxin F, a VAMP-specific endopeptidase, inhibits Ca(2+)-stimulated GH secretion from rat pituitary cells" Regul Pept, vol. 71, No. 1, Jul. 23, 1997, whole document.
Schally, et al. "Antagonists of growth hormone-releasing hormone in oncology" Current topics in Medicinal Chemistry, Bentham Science Publishers Ltd., Netherlands, vol. 9, No. 3, Mar. 1, 2006, pp. 163-170.
International Search Report (Form PCT/ISA/210), PCT/GB2009/050665 May 2005.
United Kingdom Search Reports, Oct. 2008.
Sebastian J.C.M.M. Neggers "Long-Term Efficacy and Safety of Combined Treatment of Somatostatin Analogs and Pegvisomant in Acromegaly" The Journal of Clinical Endocrinology & Metabolism 92 (12) : 4598-4601 [2007].
J. A. Chaddock "Clostridial Neurotoxins: Structure-Function Led Design of New Therapeutics" Cellular and Molecular Life Sciences 63 [2006] 540-551.
S. Petersenn "Pasireotide (SOM230) Demonstrates Efficacy and Safety in Patients with Acromegaly: A Randomized, Multicenter, Phase II Trial" The Journal of Clinical Endocrinology & Metabolism [2010] 95:2781-2789.

* cited by examiner

*Primary Examiner* — Jeffrey Stucker
*Assistant Examiner* — Aurora M Fontainhas
(74) *Attorney, Agent, or Firm* — Morris, Manning & Martin, LLP; Christopher W. Raimund

(57) ABSTRACT

The present invention relates to a method for suppressing neuroendocrine disease. The therapy employs use of a non-cytotoxic protease, which is targeted to a neuroendocrine tumor cell, preferably via a somatostatin or cortistatin receptor, a GHRH receptor, a ghrelin receptor, a bombesin receptor, a urotensin receptor a melanin-concentrating hormone receptor 1; a KiSS-1 receptor or a prolactin-releasing peptide receptor. When so delivered, the protease is internalized and inhibits secretion from said tumor cell. The present invention also relates to polypeptides and nucleic acids for use in said methods.

8 Claims, 9 Drawing Sheets

Figure 1:
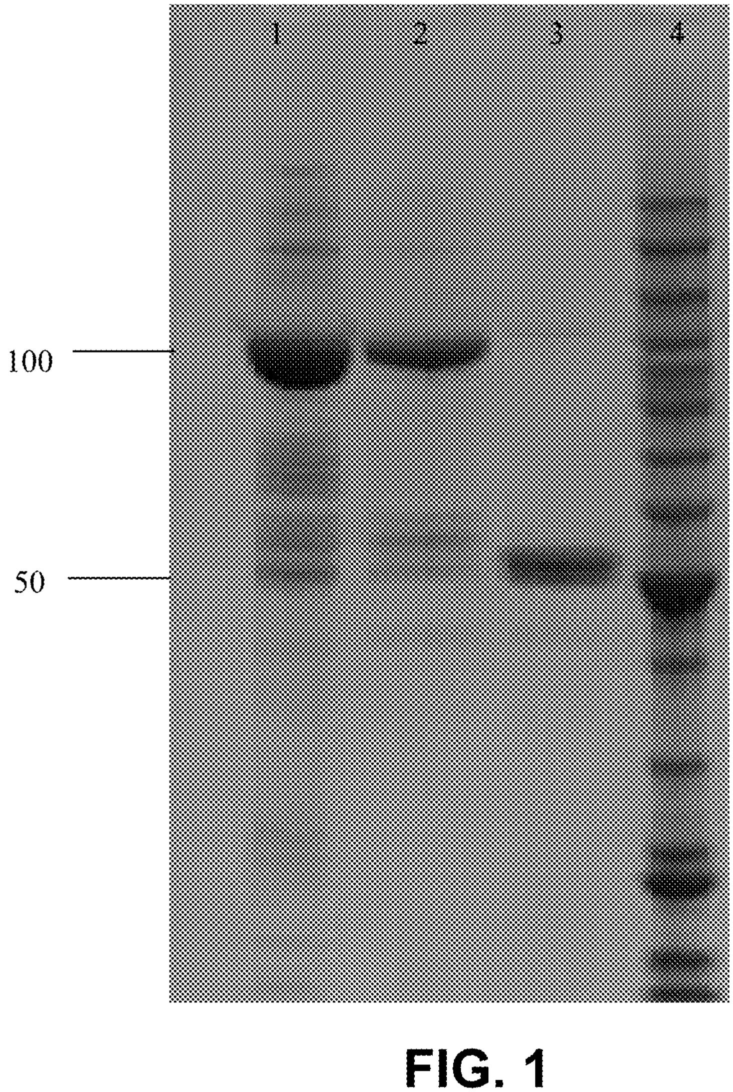

ACTH secretion and SNAP25 cleavage from AtT20-D16vF2 cells treated with SST-LHnA

- ACTH secretion as % untreated
- % uncleaved SNAP25

[SST-LHnA] nM

| 1nM SST/A | 10nM SST/A | 100nM SST/A | 0nM SST/A` |

SUPPRESSION OF NEUROENDOCRINE DISEASES

This application is a continuation-in-part of U.S. patent application Ser. No. 12/996,643, which is a national stage application of International Application No. PCT/GB2009/050665, filed on Jun. 11, 2009, the entirety of which is incorporated by reference herein.

Pursuant to the provisions of 37 C.F.R. §1.52(e)(5), the sequence listing text file named 77605_Seq_Lstng.txt, created on Dec. 16, 2010 and having a size of 814,729 bytes, and which is being submitted herewith, is incorporated by reference herein in its entirety.

The present invention relates to therapeutics and corresponding therapies for the treatment of neuroendocrine diseases and conditions.

The neuroendocrine system is formed from cells derived from the embryonic neural crest, neuroectoderm and endoderm. It can be divided into cell types that form glands and others that are diffusely distributed, i.e. the disseminated or diffuse neuroendocrine system. The first group include those cells forming the pituitary, the parathyroid glands and the adrenal medulla. The second group include cells in the skin, lung, thymus thyroid, pancreas, and the GI, biliary and urogenital tracts. Neuroendocrine tumours can arise in all these locations and can cause pathophysiology by either their physical size causing localised pressure or constrictions on surrounding organs, or by abnormal secretions of a variety of hormones and other bioactive molecules. These molecules are normally secreted by non-tumour cells in physiologically appropriate amounts and under tight physiological control. When these cells form tumours, however, the secretions can be excessive leading to disease.

Current therapies for these hypersecretion diseases can include surgical removal of the tumour(s), generic anti-tumour chemotherapy, interferon therapy, radiotherapy and more specific treatment with, for example, somatostatin analogues. The preference for initial treatment mode varies according to the consultant physician and, while each of these approaches can be successful, they are not always appropriate. Depending on the size and location of the tumour surgical intervention may be considered too risky and the tumour may not be completely removed. Anti-tumour chemotherapy, interferon therapy and radiotherapy are sometimes poorly tolerated by the patient or may be contra-indicated for other reasons.

Furthermore, therapies resulting in tumour cell death also introduce the prospect of tumour lysis syndrome (TLS) occurring. TLS is a very serious and sometimes life-threatening complication of tumour therapy. It can be defined as a constellation of metabolic abnormalities resulting from spontaneous or treatment-related tumour necrosis or fulminant apoptosis. The metabolic abnormalities observed in patients with TLS include: hyperkalaemia, hyperuricaemia, and hyperphosphataemia with secondary hypocalcaemia. TLS can also lead to acute renal failure (ARF).

In the majority of patients with metastatic carcinoids and pancreatic endocrine tumours, treatment with current medicaments such as octreotide may induce a rapid improvement in clinical symptoms, such as diarrhoea, dehydration, flushing attacks, hypokalaemia, peptic ulceration, hypoglycaemic attacks and necrotic skin lesions (Kvols et al. 1986, 1987, Ruszniewski et al. 1996, Caplin et al. 1998, Kulke & Mayer 1999, Wymenga et al. 1999). However, the majority of patients show desensitisation of the inhibition of hormone secretion by octreotide and lanreotide within weeks to months. These limitations on current therapies represent a major problem.

Neuroendocrine tumours, including gastroenteropancreatic endocrine tumours and pituitary adenomas are rare and heterogeneous diseases (table 1). As a result their prognosis and long-term survival are not well known. Regardless of survival prospects, the excessive secretions from such tumours can markedly affect quality of life for the affected individuals and so effective treatment of this aberrant function is a requirement to maintain quality of life in sufferers.

TABLE 1

Incidence/prevalence of major neuroendocrine tumours (U.S. unless otherwise stated)

| Tumour type | Incidence |
|---|---|
| carcinoid tumours | Approximately 5,000 carcinoid tumours per annum are diagnosed. According to the National Cancer Institute (NCI), approximately 74% of these tumours originate in the GI tract and 25% occur in the respiratory tract. Carcinoids are rare in children and are more common in patients older than the age of 50. They are twice as common in men. Carcinoid tumours of the appendix usually are benign and often occur between the ages of 20 and 40. |
| Insulinomas | The incidence is approximately 4 cases per million per year and the prevalence is approximately 4 per million population per year |
| Gastrinomas | The incidence of gastrinomas occurring sporadically or in association with multiple endocrine neoplasia type 1 (MEN-1) is 0.1-3 per million. The prevalence of MEN-1 is 0.2-2 per 100,000. MEN-1 is diagnosed in 30-38% of patients with gastrinomas, whereas 20-61% of patients diagnosed with MEN-1 are found to have gastrinomas associated with ZES (Zollinger-Ellison Syndrome) |
| VIPomas | Prevalence = 1.12 per million of the population |
| Glucagonomas | Glucagonoma is listed as a "rare disease" by the Office of Rare Diseases (ORD) of the National Institutes of Health (NIH). Prevalence = approx 1 in 2,720,000 people in USA |

TABLE 1-continued

Incidence/prevalence of major neuroendocrine tumours (U.S. unless otherwise stated)

| Tumour type | Incidence |
|---|---|
| Prolactinoma | Incidence: 6-10 per million per year. Prevalence 60-100 per million |
| somatotrophinoma | Prevalance of Acromegaly: 40-60 per million affected people at any time; Incidence (annual) of Acromegaly: 3 per million annual cases |
| corticotrophinoma | Incidence: 2-3 per million per year. Prevalence 20-30 per million |
| phaeochromocytoma | In Western countries the prevalence of phaeochromocytoma can be estimated to lie between 1:6,500 to 1:2,500 with an annual incidence in the United States of 500 to 1,100 cases per year |
| Thyrotrophinoma | Very rare |

Generally the symptoms of these tumours vary depending on the tumour type as they each secrete different hormones causing different symptoms (table 2).

TABLE 2

Symptoms or diseases caused by hypersecretion from neuroendocrine tumours

| Tumour type | Pathophysiology and symptoms (caused by hypersecretion rather than tumour mass) |
|---|---|
| carcinoid tumours | A combination of symptoms that result from secretion of hormone or hormone-like substances (e.g. serotonin, gastrin, ACTH, histamine) that are produced by some carcinoid tumours. These symptoms include flushing, diarrhoea, cramp-like abdominal pain, swelling of skin or face and neck, wheezing, weight gain, increased body and facial hair, diabetes, headaches, oedema, lacrimation, weakness, pulmonary hypertension, symptoms of heart failure including shortness of breath |
| Insulinomas | Blurred vision, diplopia, weakness, palpitations, confusion and bizarre behaviour. Hypoglycaemia tends to occur 5 hours or so after a meal and the associated symptoms may be affected by diet, ingestion of ethanol and exercise |
| Gastrinomas | Diarrhoea, gastritis, recurrent gastric ulcers |
| VIPomas | Watery diarrhoea (3-20 litres per day), hypokalaemia, hypomagnesaemia, hypercalcaemia, acidosis, flushing, flaccid distended bladder, ileus/subileus. Diabetes or glucose intolerance are also common. |
| Glucagonomas | Necrolytic erythematous rash (often on the face, extremities and intertrigenous areas), anaemia, weight loss, impaired glucose tolerance, thrombosis and diarrhoea. |
| corticotrophinoma | Cushing's disease resulting from ACTH inducing excess circulating cortisol |
| somatotrophinoma | Acromegaly |
| prolactinoma | oligomenorrhea/amenorrhea, galactorrhea, vaginal dryness, loss of libido in females; sexual dysfunction (impotence), galactorrhea and gynaecomastia in males |
| phaeochromocytoma | A wide range of symptoms resulting from metabolic and hemodynamic actions of circulating catecholamines. Sustained or paroxysmal hypertension is the most common clinical sign found in more than 90% of patients; with decreasing frequency:- headache, palpitations, pallor, nausea, flushing, weight loss, tiredness. Anxiety/panic, orthostatic hypotension, hyperglycaemia |
| Thyrotrophinoma | Thyrotoxicosis (overactivity of the thyroid gland), symptoms of which include weight loss in spite of increased appetite, rapid heart rate, a fine tremor, increased nervousness and emotional instability, intolerance of heat, and excessive sweating staring, bulging eyes, enlargement of the thyroid gland; in about a third of cases, the tumour also produces excess growth hormone resulting in mild acromegaly |

Current therapies are highly individualised as the symptoms experienced by each patient are often different and may also be changing over time. The three potential aims of treating a patient are (1) to remove the tumour, (2) to slow down or stop the growth of the tumour or (3) to ameliorate the symptoms caused by hypersecretion from the tumour—all three may be sought in combination. The most common current therapies are described below.

Carcinoid Tumours/Carcinoid Syndrome

A 2-pronged approach is often used in the treatment of carcinoid syndrome, beginning with surgery to remove the tumour or reduce its size, followed by treatment with chemotherapy or interferons. A procedure known as hepatic embolisation may be used to control cancer that has spread from a carcinoid tumour into the liver; it helps reduce symptoms by decreasing blood supply to the liver and starving tumour cells.

A second approach involves treating symptoms with different medications: diuretics for heart disease, bronchodilators for wheezing, somatostatin analogues for wheezing, diarrhoea and flushing.

Insulinomas

The symptoms from insulinomas can sometimes be treated through diet regulation (e.g. by frequent, slow-release complex carbohydrate intake; guar gum). With malignant insulinoma, metastases may be found in the surrounding lymph nodes and liver. If the tumour cannot be localised before or during surgery (intra-operatively), it may be removed through distal pancreatectomy.

Gastrinomas

In patients with gastrinomas, antisecretory medication such as a proton pump inhibitor is used to control gastric acid hypersecretion. If a patient cannot take this medication, a total gastrectomy is recommended. Surgery has been shown to yield a 30% 5-year cure rate, and is recommended in patients without liver metastases, MEN 1, or complicating medical conditions that may limit life expectancy. (Ninety-five percent of patients with gastrinomas have tumours). Patients with metastatic disease may benefit from chemotherapy or octreotide, if chemotherapy fails.

VIPomas

First-line therapy for VIPomas aims to correct the profound hypokalaemia, dehydration and metabolic acidosis by replenishing fluids and electrolytes. Patients are typically given up to 5 L of fluid and 350 mEq of potassium daily. The optimal treatment for VIPomas is surgical removal of the primary tumour.

Glucagonomas

Surgery is used to relieve the effects of glucagonomas or to reduce the size of the tumours, though about two-third of patients are not cured by surgery even after successful tumour localisation and assessment of metastatic disease. Currently, active drugs used to treat glucagonoma do not exist Prolactinomas Medical treatment is usually with the dopamine agonists bromocriptine or cabergoline. These drugs shrink the tumour and return prolactin levels to normal in approximately 80 percent of patients. However, use of these agonists is associated with side effects such as nausea and dizziness. Surgery is an option where medical therapy cannot be tolerated or if it fails to reduce prolactin levels, restore normal reproduction and pituitary function, and reduce tumour size. However, the results of surgery depend a great deal on tumour size and prolactin level as well as the skill and experience of the neurosurgeon. Depending on the size of the tumour and how much of it is removed, studies show that 20 to 50 percent will recur, usually within five years Somatotrophinomas (e.g. Causing Acromegaly)

Current treatment for patients with acromegaly include surgical, radiation, and medical therapies. Treatment depends on the size and extent of the tumour and the need for rapid cessation of hormone function that results in serious clinical sequelae. The standard treatments include surgery (usually a transsphenoidal approach) with or without postoperative radiation therapy, bromocriptine treatment, octreotide treatment and, more recently, pegvisomant treatment. The above-described therapies have variable success.

Corticotrophinomas

For patients with corticotroph adenomas, transsphenoidal microsurgery is the treatment of choice. However, remission rates reported in most series are approximately 70% to 90%. Drug therapy is considered to be an adjunct to transsphenoidal microsurgery in cases with a residual tumour and in cases in which one is awaiting the effects of the radiation therapy. Steroidogenesis inhibitors, including mitotane, metyrapone, ketoconazole, and aminoglutethimide are used. Ketoconazole is the best tolerated of these agents, though only in about 70% of patients. Radiation therapy has been used in patients who are deemed to be poor surgical candidates and has also been used as adjunctive therapy in patients with residual or recurrent active tumour.

Phaeochromocytoma

Laparoscopic tumour removal is the preferred procedure. However, complications during surgery need to be kept to a minimum by appropriate preoperative medical treatment to prevent catecholamine-induced, serious, and potentially life-threatening complications during surgery, including hypertensive crises, cardiac arrhythmias, pulmonary oedema, and cardiac ischaemia. Traditional regimens include α-adrenoceptor blockers, combined α/(β-adrenoceptor blockers and, calcium-channel blockers, all of which can have undesired effects both before and after surgery.

Thyrotrophinomas

Transsphenoidal surgery is the treatment of choice for patients with thyrotrophic adenomas. Adjuvant radiation therapy may be employed when surgery is known to be non-curative even if the patient is still euthyroid because relapse is inevitable, and the full effect of radiation therapy requires months or years. Medical therapy may be required for patients who still have hyperthyroid symptoms despite surgery and external radiation.

As well as representing rare, but life-affecting, human conditions neuroendocrine tumours continue to pose a major problem for animal healthcare on a global scale. Accordingly, there is a need in the art for alternative and/or improved therapeutics and therapies that address one or more of the above problems.

In all cases, surgery can be of limited success as well as carrying inherent risks to the patient. In addition, current drug treatments also are no guarantee of success in alleviating the symptoms in all patients.

The present invention solves one or more of the above problems or risks associated with surgery or existing medical therapies, by providing a new category of non-cytotoxic agent designed to suppress undesirable (e.g. abnormally elevated) tumour secretions and thus minimising or reversing the resultant disease.

In more detail, a first aspect of the present invention provides a polypeptide for use in suppressing secretion(s) from a neuroendocrine tumour, said polypeptide comprising:

a. a non-cytotoxic protease, which protease is capable of cleaving a protein of the exocytic fusion apparatus in a neuroendocrine tumour cell;
b. a Targeting Moiety (TM) that is capable of binding to a Binding Site on a neuroendocrine tumour cell, which Binding Site is capable of undergoing endocytosis to be incorporated into an endosome within the neuroendocrine tumour cell; and c. a translocation domain that is capable of translocating the protease from within an endosome, across the endosomal membrane and into the cytosol of the neuroendocrine tumour cell.

In use, a polypeptide of the invention binds to a neuroendocrine tumour cell. Thereafter, the translocation component effects transport of the protease component into the cytosol of the tumour cell. Finally, once inside, the protease inhibits the exocytic fusion process of the neuroendocrine tumour cell. Thus, by inactivating the exocytic fusion apparatus of the neuroendocrine tumour cell, the polypeptide of the invention inhibits secretion therefrom. Accordingly, the polypeptides of the present invention suppress/treat one or more of the various pathophysiological conditions or symptoms listed in Table 2 above.

The principal target cells of the present invention are tumour cells of neuroendocrine origin that secrete one or more hormones (or other bioactive molecules) leading to the development of a pathophysiological condition.

The present invention provides polypeptides that are capable of (and for use in) suppression of the secretion of hormones and/or other bioactive molecules from neuroendocrine tumours.

In a related aspect of the present invention, there is provided a method for treating a neuroendocrine tumour in a patient, said method comprising administering to the patient a therapeutically effective amount of a polypeptide of the present invention.

Without wishing to be bound by any theory, the present inventors believe that undesirable (e.g. unusual levels of) secretion of physiologically active molecules from neuroendocrine tumours cause and maintain pathological conditions in a patient. Thus, by inhibiting said secretions, the progression of the disease state can be halted and the symptoms reversed.

The polypeptides of the present invention are particularly suited for use in treating a range of neuroendocrine tumours, including their hormone-secreting metastases, precancerous conditions and symptoms thereof. In this regard, 'treating' includes reducing or eliminating excessive secretions from such cells.

By way of example, important neuroendocrine tumour target cells of the present invention include: pituitary adenomas and/or gastroenteropancreatic neuroendocrine tumours (GEP-NETs). GEP-NETs are located mainly in the stomach, intestine or pancreas and secrete excessive amounts of hormones and other bioactive molecules that are normally secreted at lower levels under physiological regulation. These secretions contribute to the symptoms experienced by the patients. GEP-NETs can be divided into carcinoid and non-carcinoid subtypes.

Carcinoid GEP-NETs (55% of all GEP-NETs) tend to be classified according to their tissue location and include, in order of prevalence, those arising from cells in the appendix (38%), ileum (23%), rectum (13%) and bronchus (11.5%).

Non-carcinoid GEP-NETs include insulinomas of the pancreatic islets secreting excess insulin (17%), tumours of unknown type (15%), gastrinomas of the pancreas or duodenum secreting excess gastrin (9%), VIPomas of the pancreas, lung or ganglioneuromas, secreting excess vasoactive intestinal polypeptide, and glucagonomas, tumours of the pancreatic islets secreting excess glucagon.

The pituitary tumours, which tend to be classified according to their secretion type or cellular identity, include: prolactinomas secreting prolactin (the most common), somatotrophinomas (growth hormone, corticotropininomas (adrenocorticotrophic hormone), thyrotrophinomas (thyroid stimulating hormone), gonadotrophinomas (FSH, LH), and non-functioning pituitary adenomas.

Other secretory tumours include thyroid medullary tumours, small and non-small cell lung tumours, Merkel cell tumours, and phaeochromocytomas. The latter can be deadly if excessive secreted adrenaline leads to severe hypertension. Such hypersecretion can make the individual unsuitable for surgery to remove tumour mass and so a reinforcing deleterious cycle can emerge and treatment of the tumour to minimise secretion is desirable.

A particularly preferred sub-set of neuroendocrine tumour cells addressed by the present invention is: insulinomas, gastrinomas, VIPomas, glucagonomas, prolactinomas, somatotrophinomas, corticotrophinomas, thyrotrophinomas and phaeochromocytomas.

By suppressing the secretory functions of neuroendocrine tumour cells (such as the above sub-set of tumour cells), the present invention provides a therapy for the treatment of, amongst others, conditions such as Cushing's disease, acromegaly, carcinoid syndrome, hypoglycaemic syndrome, necrolytic migratory erythema, Zollinger-Ellison syndrome and Verner-Morrison syndrome. Also provided are therapies for treatment of the symptoms ensuing from undesirable neuroendocrine tumour secretions (see Table 2).

The 'bioactive' component of the polypeptides of the present invention is provided by a non-cytotoxic protease. This distinct group of proteases act by proteolytically-cleaving intracellular transport proteins known as SNARE proteins (e.g. SNAP-25, VAMP, or Syntaxin)—see Gerald K (2002) "Cell and Molecular Biology" (4th edition) John Wiley & Sons, Inc. The acronym SNARE derives from the term Soluble NSF Attachment Receptor, where NSF means N-ethylmaleimide-Sensitive Factor. SNARE proteins are integral to intracellular vesicle formation, and thus to secretion of molecules via vesicle transport from a cell. Accordingly, once delivered to a desired target cell, the non-cytotoxic protease is capable of inhibiting cellular secretion from the target cell.

Non-cytotoxic proteases are a discrete class of molecules that do not kill cells; instead, they act by inhibiting cellular processes other than protein synthesis. Non-cytotoxic proteases are produced as part of a larger toxin molecule by a variety of plants, and by a variety of microorganisms such as *Clostridium* sp. and *Neisseria* sp.

Clostridial neurotoxins represent a major group of non-cytotoxic toxin molecules, and comprise two polypeptide chains joined together by a disulphide bond. The two chains are termed the heavy chain (H-chain), which has a molecular mass of approximately 100 kDa, and the light chain (L-chain), which has a molecular mass of approximately 50 kDa. It is the L-chain, which possesses a protease function and exhibits a high substrate specificity for vesicle and/or plasma membrane associated (SNARE) proteins involved in the exocytic process (eg. synaptobrevin, syntaxin or SNAP-25). These substrates are important components of the neurosecretory machinery.

*Neisseria sp.*, most importantly from the species *N. gonorrhoeae*, and *Streptococcus* sp., most importantly from the species *S. pneumoniae*, produce functionally similar non-cytotoxic toxin molecules. An example of such a non-cytotoxic protease is IgA protease (see WO99/58571, which is hereby incorporated in its entirety by reference thereto). Thus, the non-cytotoxic protease of the present invention is preferably a clostridial neurotoxin protease or an IgA protease.

Turning now to the Targeting Moiety (TM) component of the present invention, it is this component that binds the polypeptide of the present invention to a neuroendocrine tumour cell.

Thus, a TM of the present invention binds to a receptor on a neuroendocrine tumour cell. By way of example, a TM of the present invention may bind to a receptor selected from the group comprising: a somatostatin (sst) receptor, including splice variants thereof (e.g. $sst_1$, $sst_2$, $sst_3$, $sst_4$ and $sst_5$); a growth hormone-releasing hormone (GHRH) receptor—also known a GRF receptor; a ghrelin receptor; a bombesin receptor (eg. BRS-1, BRS-2, or BRS-3); a urotensin receptor (eg. a urotensin II receptor); a melanin-concentrating hormone receptor 1; a prolactin releasing hormone receptor; a gonadotropin-releasing hormone receptor (GnRHR) such as a Type 1 GnRHR and/or a Type 2 GnRHR receptor; and/or a KiSS-1 receptor.

In one embodiment, a TM of the present invention binds to a somatostatin (SST) receptor. Examples of suitable SST peptide TMs include full-length SST and cortistatin (CST), as well as truncations and peptide analogues thereof such as: SANSNPAMAPRERKAGCKNFFWKTFTSC (SST-28); AGCKNFFWKTFTSC (SST-14); QEGAPPQQSARRDRMPCRNFFWKTFSSCK (CST-29); QERPPLQQPPHRDKKPCKNFFWKTFSSCK (CST-29); QERPPPQQPPHLDKKPCKNFFWKTFSSCK (CST-29); DRMPCRNFFWKTFSSCK (CST-17); PCRNFFWKTFSSCK (CST-14); and PCKNFFWKTFSSCK (CST-14); D-Phe-Phe-Phe-D-Trp-Lys-Thr-Phe-Thr-NH2(BIM 23052), D-Phe-Phe-Tyr-D-Trp-Lys-Val-Phe-D-Nal-NH2 (BIM 23056) or c[Cys-Phe-Phe-D-Trp-Lys-Thr-Phe-Cys]-$NH_2$ (BIM23268); octreotide peptides, lanreotide peptides, BIM23027, CYN154806, BIM23027, vapreotide peptides, seglitide peptides, and SOM230. These TMs bind to sst receptors, such as $sst_1$, $sst_2$, $sst_3$, $sst_4$ and $sst_5$ receptors, which are present on neuroendocrine tumour cells relevant to the present invention—see Table 3. SST and CST have high structural homology, and bind to all known sst receptors.

TABLE 3

Expression of somatostatin receptor subtypes in gastroenteropancreatic neuroendocrine tumours (%)

| | sst1 | sst2 | sst3 | sst4 | sst5 |
|---|---|---|---|---|---|
| All tumours | 68 | 86 | 46 | 93 | 57 |
| Insulinoma | 33 | 100 | 33 | 100 | 67 |
| Gastrinoma | 33 | 50 | 17 | 83 | 50 |
| Glucagonoma | 67 | 100 | 67 | 67 | 67 |
| VIPoma | 100 | 100 | 100 | 100 | 100 |
| Non-functioning | 80 | 100 | 40 | 100 | 60 |
| mid-gut NETs | 80 | 95 | 65 | 35 | 75 |

In another embodiment, a TM of the present invention binds to a growth hormone releasing hormone (GHRH) receptor. GHRH is also known as growth-hormone-releasing factor (GRF or GHRF) or somatocrinin. Suitable GHRH peptides include full-length GHRH (1-44) peptide, and truncations thereof such as GHRH(1-27, 1-28, 1-29), GHRH(1-37), and GHRH(1-40, 1-43)-OH, as well as peptide analogues such as: BIM 28011 or NC-9-96; [MeTyr1,Ala15,22,Nle27]-hGHRH(1-29)-NH2; MeTyr1,Ala8,9,15,22,28,Nle27]-hGHRH(1-29)-NH2; cyclo(25-29)[MeTyr1,Ala15,DAsp25, Nle27,Orn29+ ++]-hGHRH(1-29)-NH2; (D-Tyr1)-GHRH (1-29)-NH2; (D-Ala2)-GHRH (1-29)-NH2; (D-Asp3)-GHRH (1-29)-NH2; (D-Ala4)-GHRH (1-29)-NH2; (D-Thr7)-GHRH (1-29)-NH2; (D-Asn8)-GHRH (1-29)-NH2; (D-Ser9)-GHRH (1-29)-NH2; (D-Tyr10)-GHRH (1-29)-NH2; (Phe4)-GHRH (1-29)-NH2; (pCI-Phe6)-GHRH (1-29)-NH2; (N-Ac-Tyr10)-GHRH (1-29)-NH2; (N-Ac-Tyr1, D-Ala2)-GHRH (1-29)-NH2; (N-Ac-D-Tyr1, D-Ala2)-GHRH (1-29)-NH2; (N-Ac-D-Tyr1, D-Ala 2, D-Asp3)-GHRH (1-29)-NH2; (D-Ala2, NLeu27)-GHRH (1-29)-NH2; (His1, D-Ala2, NLeu27)-GHRH (1-29)-NH2; (N-Ac-His1, D-Ala2, N-Leu27)-GHRH (1-29)-NH2; (His1, D-Ala 2, D-Ala 4, Nleu27)-GHRH (1-29)-NH2; (D-Ala2, D-Asp3, D-Asn8, NLeu27)-GHRH (1-29)-NH2; (D-Asp3, D-Asn8, NLeu27)-GHRH (1-29)-NH2; [His1, NLeu27]-hGHRH(1-29)-NH2; [NLeu27]-hGHRH(1-29)-NH2; H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Ser-Arg-Gln-Gln-Gly-Glu-Ser-Asn-Gln-Glu-Arg-Gly-Ala-Arg-Ala-Arg-Leu-NH2; H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Ser-Arg-NH2; H-Tyr-D-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Ser-Arg-NH2; H-Tyr-Ala-Asp-Ala-Ile-Phe-Thr-Asn-Ser-Tyr-Arg-Lys-Ile-Leu-Gly-Gln-Leu-Ser-Ala-Arg-Lys-Leu-Leu-Gln-Asp-Ile-Met-Asn-Arg-Gln-Gln-Gly-Glu-Arg-Asn-Gln-Glu-Gln-Gly-Ala-Lys-Val-Arg-Leu-NH2; H-Tyr-Ala-Asp-Ala-Ile-Phe-Thr-Asn-Ser-Tyr-Arg-Lys-Val-Leu-Gly-Gln-Leu-Ser-Ala-Arg-Lys-Leu-Leu-Gln-Asp-Ile-Met-Asn-Arg-Gln-Gln-Gly-Glu-Arg-Asn-Gln-Glu-Gln-Gly-Ala-Lys-Val-Arg-Leu-NH2; His-Val-Asp-Ala-Ile-Phe-Thr-Gln-Ser-Tyr-Arg-Lys-Val-Leu-Ala-Gln-Leu-Ser-Ala-Arg-Lys-Leu-Leu-Gln-Asp-Ile-Leu-Asn-Arg; His-Val-Asp-Ala-Ile-Phe-Thr-Gln-Ser-Tyr-Arg-Lys-Val-Leu-Ala-Gln-Leu-Ser-Ala-Arg-Lys-Leu-Leu-Gln-Asp-Ile-Leu-Asn-Arg-Gln-Gln-Gly-Glu-Arg-Asn-Gln-Glu-Gln-Gly-Ala.

In another embodiment, a TM of the present invention binds to a ghrelin receptor. Examples of suitable TMs in this regard include: ghrelin peptides such as full-length ghrelin (eg. $ghrelin_{117}$) and truncations and peptide analogues thereof such as $ghrelin_{24-117}$, $ghrelin_{52-117}$, [Trp3, Arg5]-ghrelin (1-5), des-Gln-Ghrelin, cortistatin-8, His-D-Trp-Ala-Trp-D-Phe-Lys-$NH_2$, growth hormone releasing peptide (e.g. GHRP-6), or hexarelin.

In a further embodiment, the TM binds to a bombesin receptor (eg. BRS-1, BRS-2, or BRS-3). Examples of suitable bombesin peptides include full-length: bombesin—a 14 amino acid peptide originally isolated from the skin of a frog (pGlu-Gln-Arg-Leu-Gly-Asn-Gln-Trp-Ala-Val-Gly-His-Leu-Met-$NH_2$); and the two known homologs in mammals, namely neuromedin B, and gastrin releasing peptide (GRP) such as: porcine GRP-Ala-Pro-Val-Ser-Val-Gly-Gly-Gly-Thr-Val-Leu-Ala-Lys-Met-Tyr-Pro-Arg-Gly-Asn-His-Trp-Ala-Val-Gly-His-Leu-Met-$NH_2$, and human GRP-Val-Pro-Leu-Pro-Ala-Gly-Gly-Gly-Thr-Val-Leu-Thr-Lys-Met-Tyr-Pro-Arg-Gly-Asn-His-Trp-Ala-Val-Gly-His-Leu-Met-$NH_2$. Reference to bombesin peptides embraces homologs thereof such as neuromedin B and GRP, and includes truncations and peptide analogues thereof.

In another embodiment, a TM of the present invention binds to a urotensin receptor. Suitable TMs in this regard include urotensin peptides such as Urotensin-II (U-II), which is a cyclic neuropeptide. The C-terminal cyclic region of U-II is strongly conserved across different species, and includes the six amino acid residues (-Cys Ple-Trp-Lys-Tyr-Cys-), which is structurally similar to the central region of somatostatin-14 (-Phe-Trp-Lys-Thr-). Urotensin peptides of the present invention include the U-II precursor peptides, such as prepro-urotensin-II (including the two human 124 and 139 isoforms thereof) as well as other truncations such as the eleven residue mature peptide form and peptide analogues thereof.

In a further embodiment, a TM of the present invention binds to a melanin-concentrating hormone receptor 1. Examples of suitable TMs in this regard include: melanin-concentrating hormone (MCH) peptides such as full-length MCH, truncations and analogues thereof.

In another embodiment, a TM of the present invention binds to a prolactin releasing hormone receptor. An example of a suitable TM in this regard includes prolactin releasing peptide, truncations and analogues thereof.

In another embodiment, a TM of the present invention binds to a gonadotropin-releasing hormone (GnRH) receptor. GnRH is also known as Luteinizing-Hormone Releasing Hormone (LHRH). Examples of suitable GnRH receptor TMs include: GnRHI peptides, GnRHII peptides and GnRHIII peptides, for example the full-length 92 amino acid GnRH precursor polypeptide and truncations thereof such as the decapeptide: pyroGlu-His-Trp-Ser-Tyr-Gly-Leu-Arg-Pro-Gly CONH2.

In a further embodiment, a TM of the present invention binds to a KiSS-1receptor. Examples of suitable TMs in this regard include Kisspeptin-10, Kisspeptin-54 peptides, truncations and analogues thereof.

According to a second aspect of the present invention, there is provided a composition of matter, namely a polypeptide comprising:

a. a non-cytotoxic protease, which protease is capable of cleaving a protein of the exocytic fusion apparatus in a neuroendocrine tumour cell;

b. a Targeting Moiety (TM) that is capable of binding to a Binding Site on a neuroendocrine tumour cell, which Binding Site is capable of undergoing endocytosis to be incorporated into an endosome within the neuroendocrine tumour cell; and d. a translocation domain that is capable of translocating the protease from within an endosome, across the endosomal membrane and into the cytosol of the neuroendocrine tumour cell.

All of the features of the first aspect of the present invention apply equally to the above-described second aspect.

In a preferred embodiment of the first and/or second aspects of the present invention, the TM has a human peptide amino acid sequence. Thus, a highly preferred TM is a human SST peptide, a human CST peptide or a human GHRH peptide.

Polypeptide Preparation

The polypeptides of the present invention comprise 3 principal components: a 'bioactive' (ie. a non-cytotoxic protease); a TM; and a translocation domain. The general technology associated with the preparation of such fusion proteins is often referred to as re-targeted toxin technology. By way of exemplification, we refer to: WO94/21300; WO96/33273; WO98/07864; WO00/10598; WO01/21213; WO06/059093; WO00/62814; WO00/04926; WO93/15766; WO00/61192; and WO99/58571. All of these publications are herein incorporated by reference thereto.

In more detail, the TM component of the present invention may be fused to either the protease component or the translocation component of the present invention. Said fusion is preferably by way of a covalent bond, for example either a direct covalent bond or via a spacer/linker molecule. The protease component and the translocation component are preferably linked together via a covalent bond, for example either a direct covalent bond or via a spacer/linker molecule. Suitable spacer/linked molecules are well known in the art, and typically comprise an amino acid-based sequence of between 5 and 40, preferably between 10 and 30 amino acid residues in length.

In use, the polypeptides have a di-chain conformation, wherein the protease component and the translocation component are linked together, preferably via a disulphide bond.

The polypeptides of the present invention may be prepared by conventional chemical conjugation techniques, which are well known to a skilled person. By way of example, reference is made to Hermanson, G. T. (1996), Bioconjugate techniques, Academic Press, and to Wong, S. S. (1991), Chemistry of protein conjugation and cross-linking, CRC Press, Nagy et al., PNAS 95 p 1794-99 (1998). Further detailed methodologies for attaching synthetic TMs to a polypeptide of the present invention are provided in, for example, EP0257742. The above-mentioned conjugation publications are herein incorporated by reference thereto.

Alternatively, the polypeptides may be prepared by recombinant preparation of a single polypeptide fusion protein (see, for example, WO98/07864). This technique is based on the in vivo bacterial mechanism by which native clostridial neurotoxin (i.e. holotoxin) is prepared, and results in a fusion protein having the following 'simplified' structural arrangement:

$NH_2$-[protease component]-[translocation component]-[TM]-COOH

According to WO98/07864, the TM is placed towards the C-terminal end of the fusion protein. The fusion protein is then activated by treatment with a protease, which cleaves at a site between the protease component and the translocation component. A di-chain protein is thus produced, comprising the protease component as a single polypeptide chain covalently attached (via a disulphide bridge) to another single polypeptide chain containing the translocation component plus TM.

Alternatively, according to WO06/059093, the TM component of the fusion protein is located towards the middle of the linear fusion protein sequence, between the protease cleavage site and the translocation component. This ensures that the TM is attached to the translocation domain (ie. as occurs with native clostridial holotoxin), though in this case the two components are reversed in order vis-á-vis native holotoxin. Subsequent cleavage at the protease cleavage site exposes the N-terminal portion of the TM, and provides the di-chain polypeptide fusion protein.

The above-mentioned protease cleavage sequence(s) may be introduced (and/or any inherent cleavage sequence removed) at the DNA level by conventional means, such as by site-directed mutagenesis. Screening to confirm the presence of cleavage sequences may be performed manually or with the assistance of computer software (e.g. the MapDraw program by DNASTAR, Inc.). Whilst any protease cleavage site may be employed (ie. clostridial, or non-clostridial), the following are preferred:

| | |
|---|---|
| Enterokinase | (DDDDK↓) |
| Factor Xa | (IEGR↓/IDGR↓) |
| TEV(Tobacco Etch virus) | (ENLYFQ↓G) |
| Thrombin | (LVPR↓GS) |
| PreScission | (LEVLFQ↓GP). |

Additional protease cleavage sites include recognition sequences that are cleaved by a non-cytotoxic protease, for example by a clostridial neurotoxin. These include the SNARE (eg. SNAP-25, syntaxin, VAMP) protein recognition sequences that are cleaved by non-cytotoxic proteases such as clostridial neurotoxins. Particular examples are provided in US2007/0166332, which is hereby incorporated in its entirety by reference thereto.

Also embraced by the term protease cleavage site is an intein, which is a self-cleaving sequence. The self-splicing reaction is controllable, for example by varying the concentration of reducing agent present. The above-mentioned 'activation' cleavage sites may also be employed as a 'destructive' cleavage site (discussed below) should one be incorporated into a polypeptide of the present invention.

In a preferred embodiment, the fusion protein of the present invention may comprise one or more N-terminal and/or C-terminal located purification tags. Whilst any purification tag may be employed, the following are preferred:

His-taq (e.g. 6× histidine), preferably as a C-terminal and/or N-terminal tag

MBP-tag (maltose binding protein), preferably as an N-terminal tag

GST-tag (glutathione-S-transferase), preferably as an N-terminal tag

His-MBP-tag, preferably as an N-terminal tag

GST-MBP-tag, preferably as an N-terminal tag

Thioredoxin-tag, preferably as an N-terminal tag

CBD-tag (Chitin Binding Domain), preferably as an N-terminal tag.

One or more peptide spacer/linker molecules may be included in the fusion protein. For example, a peptide spacer may be employed between a purification tag and the rest of the fusion protein molecule.

Thus, a third aspect of the present invention provides a nucleic acid (e.g. DNA) sequence encoding a polypeptide as described above (i.e. the second aspect of the present invention).

Said nucleic acid may be included in the form of a vector, such as a plasmid, which may optionally include one or more of an origin of replication, a nucleic acid integration site, a promoter, a terminator, and a ribosome binding site.

The present invention also includes a method for expressing the above-described nucleic acid sequence (i.e. the third aspect of the present invention) in a host cell, in particular in *E. coli* or via a baculovirus expression system.

The present invention also includes a method for activating a polypeptide of the present invention, said method comprising contacting the polypeptide with a protease that cleaves the polypeptide at a recognition site (cleavage site) located between the non-cytotoxic protease component and the translocation component, thereby converting the polypeptide into a di-chain polypeptide wherein the non-cytotoxic protease and translocation components are joined together by a disulphide bond. In a preferred embodiment, the recognition site is not native to a naturally-occurring clostridial neurotoxin and/or to a naturally-occurring igA protease.

The polypeptides of the present invention may be further modified to reduce or prevent unwanted side-effects associated with dispersal into non-targeted areas. According to this embodiment, the polypeptide comprises a destructive cleavage site. The destructive cleavage site is distinct from the 'activation' site (i.e. di-chain formation), and is cleavable by a second protease and not by the non-cytotoxic protease. Moreover, when so cleaved at the destructive cleavage site by the second protease, the polypeptide has reduced potency (e.g. reduced binding ability to the intended target cell, reduced translocation activity and/or reduced non-cytotoxic protease activity). For completeness, any of the 'destructive' cleavage sites of the present invention may be separately employed as an 'activation' site in a polypeptide of the present invention.

Thus, according to this embodiment, the present invention provides a polypeptide that can be controllably inactivated and/or destroyed at an off-site location.

In a preferred embodiment, the destructive cleavage site is recognised and cleaved by a second protease (i.e. a destructive protease) selected from a circulating protease (e.g. an extracellular protease, such as a serum protease or a protease of the blood clotting cascade), a tissue-associated protease (e.g. a matrix metalloprotease (MMP), such as an MMP of muscle), and an intracellular protease (preferably a protease that is absent from the target cell).

Thus, in use, should a polypeptide of the present invention become dispersed away from its intended target cell and/or be taken up by a non-target cell, the polypeptide will become inactivated by cleavage of the destructive cleavage site (by the second protease).

In one embodiment, the destructive cleavage site is recognised and cleaved by a second protease that is present within an off-site cell-type. In this embodiment, the off-site cell and the target cell are preferably different cell types. Alternatively (or in addition), the destructive cleavage site is recognised and cleaved by a second protease that is present at an off-site location (e.g. distal to the target cell). Accordingly, when destructive cleavage occurs extracellularly, the target cell and the off-site cell may be either the same or different cell-types. In this regard, the target cell and the off-site cell may each possess a receptor to which the same polypeptide of the invention binds.

The destructive cleavage site of the present invention provides for inactivation/destruction of the polypeptide when the polypeptide is in or at an off-site location. In this regard, cleavage at the destructive cleavage site minimises the potency of the polypeptide (when compared with an identical polypeptide lacking the same destructive cleavage site, or possessing the same destructive site but in an uncleaved form). By way of example, reduced potency includes: reduced binding (to a mammalian cell receptor) and/or reduced translocation (across the endosomal membrane of a mammalian cell in the direction of the cytosol), and/or reduced SNARE protein cleavage.

When selecting destructive cleavage site(s) in the context of the present invention, it is preferred that the destructive cleavage site(s) are not substrates for any proteases that may be separately used for post-translational modification of the polypeptide of the present invention as part of its manufacturing process. In this regard, the non-cytotoxic proteases of the present invention typically employ a protease activation event (via a separate 'activation' protease cleavage site, which is structurally distinct from the destructive cleavage site of the present invention). The purpose of the activation cleavage site is to cleave a peptide bond between the non-cytotoxic protease and the translocation or the binding components of the polypeptide of the present invention, thereby providing an 'activated' di-chain polypeptide wherein said two components are linked together via a di-sulfide bond.

Thus, to help ensure that the destructive cleavage site(s) of the polypeptides of the present invention do not adversely affect the 'activation' cleavage site and subsequent di-sulfide bond formation, the former are preferably introduced into polypeptide of the present invention at a position of at least 20, at least 30, at least 40, at least 50, and more preferably at least 60, at least 70, at least 80(contiguous) amino acid residues away from the 'activation' cleavage site.

The destructive cleavage site(s) and the activation cleavage site are preferably exogenous (i.e. engineered/artificial) with regard to the native components of the polypeptide. In other words, said cleavage sites are preferably not inherent to the corresponding native components of the polypeptide. By way of example, a protease or translocation component based on BoNT/A L-chain or H-chain (respectively) may be engineered according to the present invention to include a cleavage site. Said cleavage site would not, however, be present in the corresponding BoNT native L-chain or H-chain. Similarly, when the Targeting Moiety component of the polypeptide is engineered to include a protease cleavage site, said cleavage site would not be present in the corresponding native sequence of the corresponding Targeting Moiety.

In a preferred embodiment of the present invention, the destructive cleavage site(s) and the 'activation' cleavage site are not cleaved by the same protease. In one embodiment, the two cleavage sites differ from one another in that at least one, more preferably at least two, particularly preferably at least three, and most preferably at least four of the tolerated amino acids within the respective recognition sequences is/are different.

By way of example, in the case of a polypeptide chimera containing a Factor Xa 'activation' site between clostridial L-chain and $H_N$ components, it is preferred to employ a destructive cleavage site that is a site other than a Factor Xa site, which may be inserted elsewhere in the L-chain and/or $H_N$ and/or TM component(s). In this scenario, the polypeptide may be modified to accommodate an alternative 'activation' site between the L-chain and $H_N$ components (for example, an enterokinase cleavage site), in which case a separate Factor Xa cleavage site may be incorporated elsewhere into the polypeptide as the destructive cleavage site. Alternatively, the existing Factor Xa 'activation' site between the L-chain and $H_N$ components may be retained, and an alternative cleavage site such as a thrombin cleavage site incorporated as the destructive cleavage site.

When identifying suitable sites within the primary sequence of any of the components of the present invention for inclusion of cleavage site(s), it is preferable to select a primary sequence that closely matches with the proposed cleavage site that is to be inserted. By doing so, minimal structural changes are introduced into the polypeptide. By way of example, cleavage sites typically comprise at least 3 contiguous amino acid residues. Thus, in a preferred embodiment, a cleavage site is selected that already possesses (in the correct position(s)) at least one, preferably at least two of the amino acid residues that are required in order to introduce the new cleavage site. By way of example, in one embodiment, the Caspase 3 cleavage site (DMQD) may be introduced. In this regard, a preferred insertion position is identified that already includes a primary sequence selected from, for example, Dxxx, xMxx, xxQx, xxxD, DMxx, DxQx, DxxD, xMQx, xMxD, xxQD, DMQx, xMQD, DxQD, and DMxD.

Similarly, it is preferred to introduce the cleavage sites into surface exposed regions. Within surface exposed regions, existing loop regions are preferred.

In a preferred embodiment of the present invention, the destructive cleavage site(s) are introduced at one or more of the following position(s), which are based on the primary amino acid sequence of BoNT/A. Whilst the insertion positions are identified (for convenience) by reference to BoNT/A, the primary amino acid sequences of alternative protease domains and/or translocation domains may be readily aligned with said BoNT/A positions.

For the protease component, one or more of the following positions is preferred: 27-31, 56-63, 73-75, 78-81, 99-105, 120-124, 137-144, 161-165, 169-173, 187-194, 202-214, 237-241, 243-250, 300-304, 323-335, 375-382, 391-400, and 413-423. The above numbering preferably starts from the N-terminus of the protease component of the present invention.

In a preferred embodiment, the destructive cleavage site(s) are located at a position greater than 8 amino acid residues, preferably greater than 10 amino acid residues, more preferably greater than 25 amino acid residues, particularly preferably greater than 50 amino acid residues from the N-terminus of the protease component. Similarly, in a preferred embodiment, the destructive cleavage site(s) are located at a position greater than 20 amino acid residues, preferably greater than 30 amino acid residues, more preferably greater than 40 amino acid residues, particularly preferably greater than 50 amino acid residues from the C-terminus of the protease component.

For the translocation component, one or more of the following positions is preferred: 474-479, 483-495, 507-543, 557-567, 576-580, 618-631, 643-650, 669-677, 751-767, 823-834, 845-859. The above numbering preferably acknowledges a starting position of 449 for the N-terminus of the translocation domain component of the present invention, and an ending position of 871 for the C-terminus of the translocation domain component.

In a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the N-terminus of the translocation component. Similarly, in a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the C-terminus of the translocation component.

In a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the N-terminus of the TM component. Similarly, in a preferred embodiment, the destructive cleavage site(s) are located at a position greater than 10 amino acid residues, preferably greater than 25 amino acid residues, more preferably greater than 40 amino acid residues, particularly preferably greater than 50 amino acid residues from the C-terminus of the TM component.

The polypeptide of the present invention may include one or more (e.g. two, three, four, five or more) destructive protease cleavage sites. Where more than one destructive cleavage site is included, each cleavage site may be the same or different. In this regard, use of more than one destructive cleavage site provides improved off-site inactivation. Similarly, use of two or more different destructive cleavage sites provides additional design flexibility.

The destructive cleavage site(s) may be engineered into any of the following component(s) of the polypeptide: the non-cytotoxic protease component; the translocation component; the Targeting Moiety; or the spacer peptide (if present). In this regard, the destructive cleavage site(s) are chosen to ensure minimal adverse effect on the potency of the polypeptide (for example by having minimal effect on the targeting/binding regions and/or translocation domain, and/or on the non-cytotoxic protease domain) whilst ensuring that the polypeptide is labile away from its target site/target cell.

Preferred destructive cleavage sites (plus the corresponding second proteases) are listed in the Table immediately below. The listed cleavage sites are purely illustrative and are not intended to be limiting to the present invention.

| Second protease | Destructive cleavage site recognition sequence | Tolerated recognition sequence variance P4-P3-P2-P1-▼-P1'-P2'-P3' | | | | | | |
|---|---|---|---|---|---|---|---|---|
| | | P4 | P3 | P2 | P1 | P1' | P2' | P3' |
| Thrombin | LVPR▼GS | A, F, G, I, L, T, V or M | A, F, G, I, L, T, V, W or A | P | R | Not D or E | Not D or E | — |
| Thrombin | GR▼G | | | G | R | G | | |
| Factor Xa | IEGR▼ | A, F, G, I, L, T, V or M | D or E | G | R | — | — | — |
| ADAM17 | PLAQA▼VRSSS | | | | | | | |
| Human airway trypsin-like protease (HAT) | SKGR▼SLIGRV | | | | | | | |
| ACE (peptidyl-dipeptidase A) | | — | — | — | — | Not P | Not D or E | N/A |
| Elastase (leukocyte) | MEA▼VTY | M, R | E | A, H | V, T | V, T, H | Y | — |
| Furin | RXR/KR▼ | R | X | R or K | R | | | |
| Granzyme | IEPD▼ | I | E | P | D | — | — | — |
| Caspase 1 | | F, W, Y, L | — | H, A, T | D | Not P, E. D. Q. K or R | — | — |
| Caspase 2 | DVAD▼ | D | V | A | D | Not P, E. D. Q. K or R | — | — |
| Caspase 3 | DMQD▼ | D | M | Q | D | Not P, E. D. Q. K or R | — | — |
| Caspase 4 | LEVD▼ | L | E | V | D | Not P, E. D. Q. K or R | — | — |
| Caspase 5 | | L or W | E | H | D | — | — | — |
| Caspase 6 | | V | E | H or I | D | Not P, E. D. Q. K or R | — | — |
| Caspase 7 | DEVD▼ | D | E | V | D | Not P, E. D. Q. K or R | — | — |
| Caspase 8 | | I or L | E | T | D | Not P, E. D. Q. K or R | — | — |
| Caspase 9 | LEHD▼ | L | E | H | D | — | — | — |
| Caspase 10 | IEHD▼ | I | E | H | D | — | — | — |

Matrix metalloproteases (MMPs) are a preferred group of destructive proteases in the context of the present invention. Within this group, ADAM 17 (EC 3.4.24.86, also known as TACE), is preferred and cleaves a variety of membrane-anchored, cell-surface proteins to "shed" the extracellular domains. Additional, preferred MMPs include adamalysins, serralysins, and astacins.

Another group of preferred destructive proteases is a mammalian blood protease, such as Thrombin, Coagulation Factor VIIa, Coagulation Factor IXa, Coagulation Factor Xa, Coagulation Factor XIa, Coagulation Factor XIIa, Kallikrein, Protein C, and MBP-associated serine protease.

In one embodiment of the present invention, said destructive cleavage site comprises a recognition sequence having at least 3 or 4, preferably 5 or 6, more preferably 6 or 7, and particularly preferably at least 8 contiguous amino acid residues. In this regard, the longer (in terms of contiguous amino acid residues) the recognition sequence, the less likely non-specific cleavage of the destructive site will occur via an unintended second protease.

It is preferred that the destructive cleavage site of the present invention is introduced into the protease component and/or the Targeting Moiety and/or into the translocation component and/or into the spacer peptide. Of these four components, the protease component is preferred. Accordingly, the polypeptide may be rapidly inactivated by direct destruction of the non-cytotoxic protease and/or binding and/or translocation components.

Polypeptide Delivery

In use, the present invention employs a pharmaceutical composition, comprising a polypeptide, together with at least one component selected from a pharmaceutically acceptable carrier, excipient, adjuvant, propellant and/or salt.

The polypeptides of the present invention may be formulated for oral, parenteral, continuous infusion, implant, inhalation or topical application. Compositions suitable for injection may be in the form of solutions, suspensions or emulsions, or dry powders which are dissolved or suspended in a suitable vehicle prior to use.

Local delivery means may include an aerosol, or other spray (eg. a nebuliser). In this regard, an aerosol formulation of a polypeptide enables delivery to the lungs and/or other nasal and/or bronchial or airway passages.

The preferred route of administration is selected from: systemic (eg. iv), laparoscopic and/or localised injection (for example, transsphenoidal injection directly into the tumour).

In the case of formulations for injection, it is optional to include a pharmaceutically active substance to assist retention at or reduce removal of the polypeptide from the site of administration. One example of such a pharmaceutically active substance is a vasoconstrictor such as adrenaline. Such a formulation confers the advantage of increasing the residence time of polypeptide following administration and thus increasing and/or enhancing its effect.

The dosage ranges for administration of the polypeptides of the present invention are those to produce the desired therapeutic effect. It will be appreciated that the dosage range required depends on the precise nature of the polypeptide or composition, the route of administration, the nature of the formulation, the age of the patient, the nature, extent or severity of the patient's condition, contraindications, if any, and the judgement of the attending physician. Variations in these dosage levels can be adjusted using standard empirical routines for optimisation.

Suitable daily dosages (per kg weight of patient) are in the range 0.0001-1 mg/kg, preferably 0.0001-0.5 mg/kg, more preferably 0.002-0.5 mg/kg, and particularly preferably 0.004-0.5 mg/kg. The unit dosage can vary from less that 1 microgram to 30 mg, but typically will be in the region of 0.01 to 1 mg per dose, which may be administered daily or preferably less frequently, such as weekly or six monthly.

A particularly preferred dosing regimen is based on 2.5 ng of polypeptide as the 1× dose. In this regard, preferred dosages are in the range 1×-100× (i.e. 2.5-250 ng).

Fluid dosage forms are typically prepared utilising the polypeptide and a pyrogen-free sterile vehicle. The polypeptide, depending on the vehicle and concentration used, can be either dissolved or suspended in the vehicle. In preparing solutions the polypeptide can be dissolved in the vehicle, the solution being made isotonic if necessary by addition of sodium chloride and sterilised by filtration through a sterile filter using aseptic techniques before filling into suitable sterile vials or ampoules and sealing. Alternatively, if solution stability is adequate, the solution in its sealed containers may be sterilised by autoclaving. Advantageously additives such as buffering, solubilising, stabilising, preservative or bactericidal, suspending or emulsifying agents and or local anaesthetic agents may be dissolved in the vehicle.

Dry powders, which are dissolved or suspended in a suitable vehicle prior to use, may be prepared by filling presterilised ingredients into a sterile container using aseptic technique in a sterile area. Alternatively the ingredients may be dissolved into suitable containers using aseptic technique in a sterile area. The product is then freeze dried and the containers are sealed aseptically.

Parenteral suspensions, suitable for intramuscular, subcutaneous or intradermal injection, are prepared in substantially the same manner, except that the sterile components are suspended in the sterile vehicle, instead of being dissolved and sterilisation cannot be accomplished by filtration. The components may be isolated in a sterile state or alternatively it may be sterilised after isolation, e.g. by gamma irradiation.

Advantageously, a suspending agent for example polyvinylpyrrolidone is included in the composition/s to facilitate uniform distribution of the components.

Definitions Section

Targeting Moiety (TM) means any chemical structure that functionally interacts with a Binding Site to cause a physical association between the polypeptide of the invention and the surface of a target cell (typically a mammalian cell, especially a human cell). The term TM embraces any molecule (ie. a naturally occurring molecule, or a chemically/physically modified variant thereof) that is capable of binding to a Binding Site on the target cell, which Binding Site is capable of internalisation (eg. endosome formation)—also referred to as receptor-mediated endocytosis. The TM may possess an endosomal membrane translocation function, in which case separate TM and Translocation Domain components need not be present in an agent of the present invention. Throughout the preceding description, specific TMs have been described. Reference to said TMs is merely exemplary, and the present invention embraces all variants and derivatives thereof, which possess a basic binding (i.e. targeting) ability to a Binding Site on the neuroendocrine tumour cell, wherein the Binding Site is capable of internalisation.

The TM of the present invention binds (preferably specifically binds) to the target cell in question. The term "specifically binds" preferably means that a given TM binds to the target cell (e.g. to an SST receptor) with a binding affinity (Ka) of $10^6$ $M^{-1}$ or greater, preferably $10^7$ $M^{-1}$ or greater, or $10^8$ $M^{-1}$ or greater, or $10^9$ $M^{-1}$ or greater. The TMs of the present invention (when in a free form, namely when separate from any protease and/or translocation component), preferably demonstrate a binding affinity ($IC_{50}$) for the target receptor in question (eg. an SST receptor) in the region of 0.05-18 nM.

The TM of the present invention is preferably not wheat germ agglutinin (WGA).

Reference to TM in the present specification embraces fragments and variants thereof, which retain the ability to bind to the target cell in question. By way of example, a variant may have at least 80%, preferably at least 90%, more preferably at least 95%, and most preferably at least 97 or at least 99% amino acid sequence homology with the reference TM—the latter is any TM sequence recited in the present application. Thus, a variant may include one or more analogues of an amino acid (e.g. an unnatural amino acid), or a substituted linkage. Also, by way of example, the term fragment, when used in relation to a TM, means a peptide having at least five, preferably at least ten, more preferably at least twenty, and most preferably at least twenty five amino acid residues of the reference TM. The term fragment also relates to the above-mentioned variants. Thus, by way of example, a fragment of the present invention may comprise a peptide sequence having at least 7, 10, 14, 17, 20, 25, 28, 29, or 30 amino acids, wherein the peptide sequence has at least 80% sequence homology over a corresponding peptide sequence (of contiguous) amino acids of the reference peptide.

By way of example, somatostatin (SST) and cortistatin (CST) have high structural homology, and bind to all known SST receptors. Full-length SST has the amino acid sequence:

```
MLSCRLQCALAALSIVLALGCVTGAPSDPRLRQFLQKSLAAAAGKQELAK

YFLAELLSEPNQTENDALEPEDLSQAAEQDEMRLELQRSANSNPAMAPRE

RKAGCKNFFWKTFTSC
```

Full-length CST has the amino acid sequence:

```
MYRHKNSWRLGLKYPPSSKEETQVPKTLISGLPGRKSSSRVGEKLQSAHK
MPLSPGLLLLLLSGATATAALPLEGGPTGRDSEHMQEAAGIRKSSLLTFL
AWWFEWTSQASAGPLIGEEAREVARRQEGAPPQQSARRDRMPCRNFFWKT
FSSCK
```

Reference to these TMs includes the following fragments (and corresponding variants) thereof:

```
NFFWKTF;
(R or K)NFFWKTF;
C(R or K)NFFWKTF;
(P or G)C(R or K)NFFWKTF;
NFFWKTF(S or T);
NFFWKTF(S or T)S;
NFFWKTF(S or T)SC;
(R or K)NFFWKTF(S or T);
(R or K)NFFWKTF(S or T)S;
(R or K)NFFWKTF(S or T)SC;
C(R or K)NFFWKTF(S or T);
C(R or K)NFFWKTF(S or T)S;
C(R or K)NFFWKTF(S or T)SC;
```

-continued

```
(P or G)C(R or K)NFFWKTF(S or T);
(P or G)C(R or K)NFFWKTF(S or T)S; or
(P or G)C(R or K)NFFWKTF(S or T)C.
```

With regard to the above sequences, where a (P or G) alternative is given, a P is preferred in the case of a CST TM, whereas a G is preferred in the case of an SST TM. Where an (R or K) alternative is given, an R is preferred in the case of a CST TM, whereas a K is preferred in the case of an SST TM. Where an (S or T) alternative is given, an S is preferred in the case of a CST TM, whereas a T is preferred in the case of an SST TM.

Preferred fragments comprise at least 7 or at least 10 amino acid residues, preferably at least 14 or at least 17 amino acid residues, and more preferably at least 28 or 29 amino acid residues. By way of example, preferred sequences include: SANSNPAMAPRERKAGCKNFFWKTFTSC (SST-28); AGCKNFFWKTFTSC (SST-14); QEGAPPQQSARRDRMPCRNFFWKTFSSCK (CST-29); QERPPLQQPPHRDKKPCKNFFWKTFSSCK (CST-29); QERPPPQQPPHLDKKPCKNFFWKTFSSCK (CST-29); DRMPCRNFFWKTFSSCK (CST-17); PCRNFFWKTFSSCK (CST-14); and PCKNFFWKTFSSCK (CST-14).

The TM may comprise a longer amino acid sequence, for example, at least 30 or 35 amino acid residues, or at least 40 or 45 amino acid residues, so long as the TM is able to bind to a neuroendocrine tumour cell, preferably to an SST or to a CST receptor on a neuroendocrine tumour cell. In this regard, the TM is preferably a fragment of full-length SST or CST, though including at least the core sequence "NFFWKTF" or one of the above-defined primary amino acid sequences.

By way of further example, GHRH peptides of the present invention include:

```
YADAIFTASYRKVLGQLSARKLLQDILSR;      YADAIFTASYRNVLGQLSARKLLQDILSR;
YADAIFTNSYRKVLGQLSARKLLQDIM;        YADAIFTNSYRKVLGQLSARKLLQDIMS;
ADAIFTNSYRKVLGQLSARKLLQDIMSR;
YADAIFTNSYRKVLGQLSARKLLQDIMSRQQGESNQERGARARL;
YADAIFTNSYRKVLGQLSARKLLQDIMSRQQGESNQERGA;
YADAIFTNAYRKVLGQLSARKLLQDIMSR;      YADAIFTNSYRKVLGQLSARKALQDIMSR;
YADAIFTASYKKVLGQLSARKLLQDIMSR;      YADAIFTASYKRVLGQLSARKLLQDIMSR;
YADAIFTASYNKVLGQLSARKLLQDIMSR;      YADAIFTASYRKVLGQLSAKKLLQDIMSR;
YADAIFTASYKKVLGQLSAKKLLQDIMSR;      YADAIFTASYRKVLGQLSANKLLQDIMSR;
YADAIFTASYRNVLGQLSARKLLQDIMSR;      YADAIFTASYRKVLGQLSARNLLQDIMSR;
YADAIFEASYRKVLGQLSARKLLQDIMSR;      YADAIFTASERKVLGQLSARKLLQDIMSR;
YADAIFTASYRKELGQLSARKLLQDIMSR;      YADAIFTASYRKVLGQLSARKLLQDIMSR;
YADAIFTESYRKVLGQLSARKLLQDIMSR;        YADAIFTNSYRKVLAQLSARKLLQDIM;
YADAIFTNSYRKVLAQLSARKLLQDIMSR;      YADAIFTASYRKVLAQLSARKLLQDIMSR;
YADAIFTAAYRKVLAQLSARKALQDIASR;      YADAIFTAAYRKVLAQLSARKALQDIMSR;
HVDAIFTQSYRKVLAQLSARKLLQDILNRQQGERNQEQGA;
HVDAIFTQSYRKVLAQLSARKALQDILSRQQG;   HVDAIFTSSYRKVLAQLSARKLLQDILSR;
HVDAIFTTSYRKVLAQLSARKLLQDILSR;      YADAIFTQSYRKVLAQLSARKALQDILNR;
YADAIFTQSYRKVLAQLSARKALQDILSR.
```

It is routine to confirm that a TM binds to the selected target cell. For example, a simple radioactive displacement experiment may be employed in which tissue or cells representative of a neuroendocrine tumour cell are exposed to labelled (eg. tritiated) TM in the presence of an excess of unlabelled TM. In such an experiment, the relative proportions of non-specific and specific binding may be assessed, thereby allowing confirmation that the TM binds to the target cell. Optionally, the assay may include one or more binding antagonists, and the assay may further comprise observing a loss of TM binding. Examples of this type of experiment can be found in Hulme, E. C. (1990), Receptor-binding studies, a brief outline, pp. 303-311, In Receptor biochemistry, A Practical Approach, Ed. E. C. Hulme, Oxford University Press.

In the context of the present invention, reference to a peptide TM (e.g. SST peptide, CST peptide, or GHRH peptide, etc) embraces peptide analogues thereof, so long as the analogue TM binds to the same receptor as the corresponding 'reference' TM. Said analogues may include synthetic residues such as: β-Nal=β-naphthylalanine; β-Pal=β-pyridylalanine; hArg(Bu)=N-guanidino-(buryl)-homoarginine; hArg $(Et)_2$=N,N'-guanidino-(dimethyl-homoarginine; hArg $(CH_2CF_3)_2$=N,N'-guanidino-bis-(2,2,2,-trifluorethyl)-homoarginine; hArg($CH_3$, hexyl)=N,N'-guanidino-(methyl, hexyl)-homoarginine; Lys(Me)=$N^e$-methyllysine; Lys(iPr)=$N^e$-siopropyllysine; AmPhe=aminomethylphenylalanine; AChxAla=aminocyclohexylalanine; Abu=α-aminobutyric acid; Tpo=4-thiaproline; MeLeu=N-methylleucine; Orn=ornithine; Nle—norleucine; Nva=norvaline; Trp(Br)=5-bromo-tryptophan; Trp(F)=5-fluoro-tryptophan; Trp $(NO_2)$= 5-nitro-tryptophan; Gaba=γ-aminobutyric acid; Bmp=J-mercaptopropionyl; Ac=acetyl; and Pen= pencillamine By way of example, the above peptide analogue aspect is described in more detail with reference to specific peptide TMs, such as SST peptides, GHRH peptides, bombesin peptides, ghrelin peptides, GnRH (aka LHRH peptides), and urotensin peptides, though the same principle applies to all TMs of the present invention.

Somatostatin analogues, which can be used to practice the present invention include, but are not limited to, those described in the following publications, which are hereby incorporated by reference: Van Binst, G. et al. Peptide Research 5: 8 (1992); Horvath, A, et al. Abstract, "Conformations of Somatostatin Analogs Having Antitumor Activity", 22nd European peptide Symposium, Sep. 13-19, 1992, Interlaken, Switzerland; U.S. Pat. No. 5,506,339; EP0363589; U.S. Pat. No. 4,904,842; U.S. Pat. No. 4,871, 717; U.S. Pat. No. 4,725,577; U.S. Pat. No. 4,684,620; U.S. Pat. No. 4,650,787; U.S. Pat. No. 4,585,755; U.S. Pat. No. 4,725,577; U.S. Pat. No. 4,522,813; U.S. Pat. No. 4,369,179; U.S. Pat. No. 4,360,518; U.S. Pat. No. 4,328,214; U.S. Pat. No. 4,316,890; U.S. Pat. No. 4,310,518; U.S. Pat. No. 4,291, 022: U.S. Pat. No. 4,238,481; U.S. Pat. No. 4,235,886; U.S. Pat. No. 4,211,693; U.S. Pat. No. 4,190,648; U.S. Pat. No. 4,146,612; U.S. Pat. No. 4,133,782; U.S. Pat. No. 5,508,339; U.S. Pat. No. 4,261,885; U.S. Pat. No. 4,282,143; U.S. Pat. No. 4,190,575; U.S. Pat. No. 5,552,520; EP0389180; EP0505680; U.S. Pat. No. 4,603,120; EP0030920: U.S. Pat. No. 4,853,371; WO90/12811; WO97/01579; WO91/18016: WO98/08529 and WO98/08528; WO/0075186 and WO00/06185; WO99/56769; and FR 2,522,655.

Preferred analogues include: cyclo(N-Me-Ala-Tyr-D-Trp-Lys-Val-Phe) or H-D-β-Nal-Cys-Tyr-D-Trp-Lys-Thr-Cys-Thr-NH2; H-Cys-Phe-Phe-D-Trp-Lys-Thr-Phe-Cys-NH2; H-Cys-Phe-Tyr-D-Trp-Lys-Thr-Phe-Cys-NH2; H-Cys-Phe-Phe-D-Trp-Lys-Ser-Phe-Cys-NH2; H-Cys-Phe-Tyr-D-Trp-Lys-Thr-Phe-Cys-NH2; H-Cys-Phe-Phe-D-Trp-Lys-Thr-NH2; H-Cys-Phe-Phe-D-Trp-Lys-Thr-Phe-Cys-NH2; H-Phe-Phe-Phe-D-Trp-Lys-Thr-NH2; H-D-Phe-Phe-Phe-D-Trp-Lys-Thr-Phe-THr-NH2; H-Cys-Phe-Tyr(I)-D-Trp-Lys-Thr-Phe-Cys-NH2; H-D-Phe-p-chloro-Phe-Tyr-D-Trp-Lys-Thr-Phe-Thr-NH2, H-D-Phe-p-NO2-Phe-Tyr-D-Trp-Lys-Val-Phe-Thr-NH2, H-D-β-Nal-p-chloro-Phe-Tyr-D-Trp-Lys-Val-Phe-Thr-NH2, H-D-Phe-Phe-Tyr-D-Trp-Lys-Val-Phe-Thr-NH2, H-D-Phe-p-chloro-Phe-Tyr-D-Trp-Lys-Val-Phe-Thr-NH2, H-D-Phe-Ala-Tyr-D-Trp-Lys-Val-Ala-D-β-Nal-NH2; H-D-β-Nal-Cys-Tyr-D-Trp-Lys-Thr-Cys-Thr-NH2; H-D-Phe-Cys-Phe-D-Trp-Lys-Thr-Cys-β-Nal-NH2; H-D-Phe-Cys-Tyr-D-Trp-Lys-Thr-Cys-β-Nal-NH2; H-D-β-Nal-Cys-Phe-D-Trp-Lys-Thr-Cys-Thr-NH2; H-D-Phe-Cys-Tyr-D-Trp-Lys-Thr-Pen-Thr-NH2; H-D-Phe-Cys-Phe-D-Trp-Lys-Thr-Pen-Thr-NH2; H-D-Phe-Cys-Tyr-D-Trp-Lys-Thr-Pen-Thr-OH; H-D-Phe-Cys-Phe-D-Trp-Lys-Thr-Pen-Thr-OH; H-Gly-Pen-Phe-D-Trp-Lys-Thr-Cys-Thr-OH; H-Phe-Pen-Tyr-D-Trp-Lys-Thr-Cys-Thr-OH; H-Phe-Pen-Phe-D-Trp-Lys-Thr-Pen-Thr-OH; H-D-Phe-Cys-Phe-D-Trp-Lys-Thr-Cys-Thr-ol; H-D-Phe-Cys-Phe-D-Trp-Lys-Thr-Cys-Thr-NH2; H-D-Trp-Cys-Tyr-D-Trp-Lys-Val-Cys-Thr-NH2; H-D-Trp-Cys-Phe-D-Trp-Lys-Thr-Cys-Thr-NH2; H-D-Phe-Cys-Tyr-D-Trp-Lys-Val-Cys-Thr-NH2; H-D-Phe-Cys-Tyr-D-Trp-Lys-Val-Cys-Trp-NH2; H-D-Phe-Cys-Tyr-D-Trp-Lys-Val-Cys-Thr-NH2; Ac-D-Phe-Lys-Tyr-D-Trp-Lys-Val-Asp*-Thr-NH2 (an amide bridge formed between Lys* and Asp*); Ac-hArg (Et) 2-Gly-Cys-Phe-D-Trp-Lys-Thr-Cys-Thr-NH2; Ac-D-hArg (Et) 2-Gly-Cys-Phe-D-Trp-Lys-Thr-Cys-Thr-NH2; Ac-D-hArg (Bu)-Gly-Cys-Phe-D-Trp-Lys-Thr-Cys-Thr-NH2; Ac-D-hArg (Et) 2-Cys-Phe-D-Trp-Lys-Thr-Cys-Thr-NH2; Ac-L-hArg (Et) 2-Cys-Phe-D-Trp-Lys-Thr-Cys-Thr-NH2; Ac-D-hArg (CH2CF3) 2-Cys-Phe-D-Trp-Lys-Thr-Cys-Thr-NH2; Ac-D-hArg (CH2CF3) 2-Gly-Cys-Phe-D-Trp-Lys-Thr-Cys-Thr-NH2; Ac-D-hArg (CH2CF3) 2-Gly-Cys-Phe-D-Trp-Lys-Thr-Cys-Phe-NH2; Ac-D-hArg (CH2CF3) 2-Gly-Cys-Phe-D-Trp-Lys-Thr-Cys-Thr-NHEt; Ac-L-hArg (CH2-CF3) 2-Gly-Cys-Phe-D-Trp-Lys-Thr-Cys-Thr-NH2; Ac-D-hArg (CH2CF3) 2-Gly-Cys-Phe-D-Trp-Lys (Me)-Thr-Cys-Thr-NH2; Ac-D-hArg (CH2CF3) 2-Gly-Cys-Phe-D-Trp-Lys (Me)-Thr-Cys-Thr-NHEt; Ac-hArg (CH3, hexyl)-Gly-Cys-Phe-D-Trp-Lys-Thr-Cys-Thr-NH2; H-hArg (hexyl2)-Gly-Cys-Phe-D-Trp-Lys-Thr-Cys-Thr-NH2; Ac-D-hArg (Et) 2-Gly-Cys-Phe-D-Trp-Lys-Thr-Cys-Thr-NHEt; Ac-D-hArg (Et) 2-Gly-Cys-Phe-D-Trp-Lys-Thr-Cys-Phe-NH2; Propionyl-D-hArg (Et) 2-Gly-Cys-Phe-D-Trp-Lys (iPr)-Thr-Cys-Thr-NH2; Ac-D-β-Nal-Gly-Cys-Phe-D-Trp-Lys-Thr-Cys-Gly-hArg (Et) 2-NH2; Ac-D-Lys (iPr)-Gly-Cys-Phe-D-Trp-Lys-Thr-Cys-Thr-NH2; Ac-D-hArg (CH2CF3) 2-D-hArg (CH2CF3) 2-Gly-Cys-Phe-D-Trp-Lys-Thr-Cys-Thr-NH2; Ac-D-hArg (CH2CF3) 2-D-hArg (CH2CF3) 2-Gly-Cys-Phe-D-Trp-Lys-Thr-Cys-Phe-NH2; Ac-D-hArg (Et) 2-D-hArg (Et) 2-Gly-Cys-Phe-D-Trp-Lys-Thr-Cys-Thr-NH2; c-Cys-Lys-Asn-4-Cl-Phe-Phe-D-Trp-Lys-Thr-Phe-Thr-Ser-D-Cys-NH2; H-Bmp-Tyr-D-Trp-Lys-Val-Cys-Thr-NH2; H-Bmp-Tyr-D-Trp-Lys-Val-Cys-Phe-NH2; H-Bmp-Tyr-D-Trp-Lys-Val-Cys-p-Cl-Phe-NH2; H-Bmp-Tyr-D-Trp-Lys-Val-Cys-p-Nal-NH2; H-D-β-Nal-Cys-Tyr-D-Trp-Lys-Val-Cys-Thr-NH2; H-D-Phe-Cys-Tyr-D-Trp-Lys-Abu-Cys-Thr-NH2; H-D-Phe-Cys-Tyr-D-Trp-Lys-Abu-Cys-beta-Nal-NH2; H-pentafluoro-D-Phe-Cys-Tyr-D-Trp-Lys-Val-Cys-Thr-NH2; Ac-D-β-Nal-Cys-pentafluoro-Phe-D-Trp-Lys-Val-Cys-Thr-NH2; H-D-i-Nal-Cys-Tyr-D-Trp-Lys-Val-Cys-p-Nal-NH2; H-D-Phe-Cys-Tyr-D-Trp-Lys-Val-Cys-β-Nal-NH2; H-D-, SNal-Cys-Tyr-D-Trp-Lys-Abu-Cys-Thr-NH2; H-D-p-Cl-Phe-Cys-Tyr-D-Trp-Lys-Abu-Cys-Thr-NH2; Ac-D-P-Cl- Phe-Cys-Tyr-D-Trp-Lys-Abu-Cys-Thr-NH2; H-D-Phe-Cys-p-Nal-D-Trp-Lys-Val-Cys-Thr-NH2; H-D-Phe-Cys-Tyr-D-Trp-Lys-Cys-Thr-NH2; cyclo (Pro-Phe-D-Trp-N-Me-Lys-Thr-Phe); cyclo (Pro-Phe-D-Trp-N-Me-Lys-Thr-Phe); cyclo (Pro-Phe-D-Trp-Lys-Thr-N-Me-Phe); cyclo (N-Me-Ala-Tyr-D-Trp-Lys-Thr-Phe); cyclo (Pro-Tyr-D-Trp-Lys-Thr-Phe); cyclo (Pro-Phe-D-Trp-Lys-Thr-Phe); cyclo (Pro-Phe-L-Trp-Lys-Thr-Phe); cyclo (Pro-Phe-D-Trp (F)-Lys-Thr-Phe); cyclo (Pro-Phe-Trp (F)-Lys-Thr-Phe); cyclo (Pro-Phe-D-Trp-Lys-Ser-Phe); cyclo (Pro-Phe-D-Trp-Lys-Thr-p-Cl-Phe); cyclo (D-Ala-N-Me-D-Phe-D-Thr-D-Lys-Trp-D-Phe); cyclo (D-Ala-N-Me-D-Phe-D-Val-Lys-D-Trp-D-Phe); cyclo (D-Ala-N-Me-D-Phe-D-Thr-Lys-D-Trp-D-Phe); cyclo (D-Abu-N-Me-D-Phe-D-Val-Lys-D-Trp-D-Tyr); cyclo (Pro-Tyr-D-Trp-t-4-AchxAla-Thr-Phe); cyclo (Pro-Phe-D-Trp-t-4-AchxAla-Thr-Phe); cyclo (N-Me-Ala-Tyr-D-Trp-Lys-Val-Phe); cyclo (N-Me-Ala-Tyr-D-Trp-t-4AchxAla-Thr-Phe); cyclo (Pro-Tyr-D-Trp-4-Amphe-Thr-Phe); cyclo (Pro-Phe-D-Trp-4-Amphe-Thr-Phe); cyclo (N-Me-Ala-Tyr-D-Trp-4-Amphe-Thr-Phe); cyclo (Asn-Phe-Phe-D-Trp-Lys-Thr-Phe-Gaba); cyclo (Asn-Phe-Phe-D-Trp-Lys-Thr-Phe-Gaba-Gaba); cyclo (Asn-Phe-D-Trp-Lys-Thr-Phe); cyclo (Asn-Phe-Phe-D-Trp-Lys-Thr-Phe-NH (CH2) 4CO); cyclo (Asn-Phe-Phe-D-Trp-Lys-Thr-Phe->Ala); cyclo (Asn-Phe-Phe-D-Trp-Lys-Thr-Phe-D-Glu)-OH; cyclo (Phe-Phe-D-Trp-Lys-Thr-Phe); cyclo (Phe-Phe-D-Trp-Lys-Thr-Phe-Gly); cyclo (Phe-Phe-D-Trp-Lys-Thr-Phe-Gaba); cyclo (Asn-Phe-Phe-D-Trp-Lys-Thr-Phe-Gly); cyclo (Asn-Phe-Phe-D-Trp (F)-Lys-Thr-Phe-Gaba); cyclo (Asn-Phe-Phe-D-Trp (NO2)-Lys-Thr-Phe-Gaba); cyclo (Asn-Phe-Phe-Trp (Br)-Lys-Thr-Phe-Gaba); cyclo (Asn-Phe-Phe-D-Trp-Lys-Thr-Phe (I)-Gaba); cyclo (Asn-Phe-Phe-D-Trp-Lys-Thr-Tyr (But)-Gaba); cyclo (Bmp-Lys-Asn-Phe-Phe-D-Trp-Lys-Thr-Phe-Thr-Pro-Cys)-OH; cyclo (Bmp-Lys-Asn-Phe-Phe-D-Trp-Lys-Thr-Phe-Thr-Pro-Cys)-OH; cyclo (Bmp-Lys-Asn-Phe-Phe-D-Trp-Lys-Thr-Phe-Thr-Tpo-Cys)-OH; cyclo (Bmp-Lys-Asn-Phe-Phe-D-Trp-Lys-Thr-Phe-Thr-MeLeu-Cys)-OH; cyclo (Phe-Phe-D-Trp-Lys-Thr-Phe-Phe-Gaba); cyclo (Phe-Phe-D-Trp-Lys-Thr-Phe-D-Phe-Gaba); cyclo (Phe-Phe-D-Trp (5F)-Lys-Thr-Phe-Phe-Gaba); cyclo (Asn-Phe-Phe-D-Trp-Lys (Ac)-Thr-Phe-NH-(CH2) 3-CO); cyclo (Lys-Phe-Phe-D-Trp-Lys-Thr-Phe-Gaba); cyclo (Lys-Phe-Phe-D-Trp-Lys-Thr-Phe-Gaba); cyclo (Orn-Phe-Phe-D-Trp-Lys-Thr-Phe-Gaba); H-Cys-Phe-Phe-D-Trp-Lys-Thr-Phe-Cys-NH2; H-Cys-Phe-Phe-D-Trp-Lys-Ser-Phe-Cys-NH2; H-Cys-Phe-Tyr-D-Trp-Lys-Thr-Phe-Cys-NH2; H-Cys-Phe-Tyr (I)-D-Trp-Lys-Thr-Phe-Cys-NH2.

Methods for synthesizing analogues are well documented, as illustrated, for example, by the patents cited above. For example, synthesis of H-D-Phe-Phe-Phe-D-Trp-Lys-Thr-Phe-Thr-NH2, can be achieved by following the protocol set forth in Example 1 of EP0395417A1. Similarly, synthesis analogues with a substituted N-terminus can be achieved, for example, by following the protocol set forth in WO88/02756, EP0329295, and U.S. Pat. No. 5,240,561.

Preferred examples of linear analogues include: H-D-Phe-p-chloro-Phe-Tyr-D-Trp-Lys-Thr-Phe-Thr-NH2; H-D-Phe-p-N02-Phe-Tyr-D-Trp-Lys-Val-Phe-Thr-NH2; H-D-*Nal-p-chloro-Phe-Tyr-D-Trp-Lys-Val-Phe-Thr-NH2; H-D-Phe-Phe-Phe-D-Trp-Lys-Thr-Phe-Thr-NH2; H-D-Phe-Phe-Tyr-D-Trp-Lys-Val-Phe-Thr-NH2; H-D-Phe-p-chloro-Phe-Tyr-D-Trp-Lys-Val-Phe-Thr-NH2; and H-D-Phe-Ala-Tyr-D-Trp-Lys-Val-Ala-D-beta-Nal-NH2.

One or more chemical moieties, eg. a sugar derivative, mono or poly-hydroxy (C2-12) alkyl, mono or poly-hydroxy (C2-12) acyl groups, or a piperazine derivative, can be attached to a SST analogue, e g, to the N-terminus amino acid—see WO88/02758, EP0329295, and U.S. Pat. No. 5,240,561.

Further examples of SST analogues that can be used as a TM in the present invention include the following: D-Cpa-cyclo[Cys-Tyr-D-Trp-Lys-Val-Cys]-Thr-NH2; D-Phe-cyclo[Cys-Tyr-D-Trp-Lys-Val-Cys]-Thr-NH2; D-Phe-cyclo[Cys-p-NH2-Phe-D-Trp-Lys-Val-Cys]-Thr-NH2; N-Me-D-Phe-cyclo[Cys-Tyr-D-Trp-Lys-Val-Cys]-Thr-NH2; D-Phe-cyclo[Cys-Tyr-D-Pal-Lys-Val-Cys]-Thr-NH2; Ac-D-Nal-cyclo[Cys-Tyr-D-Trp-Lys-Val-Cys]-Thr-NH2; D-Phe-cyclo[Cys-Tyr-D-Trp-Lys-Val-Cys]-Nal-NH2; D-Nal-cyclo[Cys-Tyr-D-Trp-Lys-Val-Cys]-Nal-NH2; D-Nal-cyclo[Cys-Tyr-D-Trp-Lys-Val-Cys]-Thr-OH; ED-Phe-cyclo[Cys-Nal-D-Trp-Lys-Val-Cys]-Thr-NH2; D-Nal-cyclo[Cys-Tyr-D-Nal-Lys-Val-Cys]-Nal-NH2; D-Nal-cyclo[Cys-Tyr-D-Trp-Lys-Val-D-Cys]-Nal-NH2; D-Trp-cyclo[Cys-Tyr-D-Trp-Lys-Val-Cys]-Nal-NH2; D-Nal-cyclo[Cys-Tyr-D-Trp-Lys-Val-Cys]-D-Nal-NH2; Nal-cyclo[Cys-Tyr-D-Trp-Lys-Val-Cys]-D-Nal-NH2; (AcO-CH2)3-C—NH—CO-(CH2)2-CO-D-Nal-cyclo(Cys-Tyr-D-Trp-Lys-Val-Cys]Thr-NH2; [3-O-(2,5,6-triacetyl ascorbic)acetyl-D-Nal-cyclo[Cys-Tyr-D-Trp-Lys-Val-Cys]-Thr-NH2; D-Nal-cyclo[Cys-Tyr-D-Trp-Lys-Val-Cys]-Trp-NH2; Phe-cyclo[Cys-Tyr-D-Trp-Lys-Val-Cys]-Trp-NH2; 3-O-(ascorbic)-butyrl-D-Nal-cyclo[Cys-Tyr-D-Trp-Lys-Val-Cys]-Thr-NH2; 3O-(ascorbic acid)Ac-D-Nal-cyclo[Cys-Tyr-D-Trp-Lys-Val-Cys]-Thr-NH2; D-Bpa-cyclo[Cys-Tyr-D-Trp-Lys-Val-Cys]-Nal-NH2; D-Nal-cyclo[Cys-Tyr-D-Trp-Lys-Val-Cys]-Bpa-NH2; Tris-Suc-D-Nal-cyclo[Cys-Tyr-D-Trp-Lys-Val-Cys]-Thr-NH2; D-Dpa-cyclo[Cys-Tyr-D-Trp-Lys-Val-Cys]-Nal-NH2; D-Nal-cyclo[Cys-Tyr-D-Trp-Lys-Val-Cys]-Dpa-NH2; Ac-D-Nal-cyclo[Cys-Tyr-D-Trp-Lys-Val-Cys]-Thr-NH2; cyclo-[Cys-Tyr-D-Trp-Lys-Val-Cys]-Thr-NH2; NmeCpa-cyclo (DCys-3-Pal-DTrp-Lys-Thr-Cys)-2-Nal-NH2; Cpa-cyclo(NMEDCys-3-Pal-DTrp-Lys-Thr-Cys)-2-Nal-NHMe; Cpa-cyclo (DCys-NMe3-Pal-DTrp-Lys-Thr-Cys)-2-Nal-NH2; Cpa-cyclo(DCys-3-Pal-NMeDTrp-Lys-Thr-Cys)-2-Nal-NH2; Cpa-cyclo(DCys-3-Pal-DTrp-NMeLys-Thr-Cys)-2-Nal-NH2; Cpa-cyclo(DCys-3-Pal-DTrp-Lys-NMeThr-Cys)-2-Nal-NH2; Cpa-cyclo (DCys-3-Pal-DTrp-Lys-Thr-NMeCys)-2-Nal-NH2; Cpa-cyclo (DCys-3-Pal-DTrp-Lys-Thr-Cys)-Nme2-Nal-NH2; Cpa-cyclo(NMeDCys-3-Pal-DTrp-Lys-Thr-Cys)-Dip-NHMe; Cpa-cyclo (DCys-3-Pal-NMeDTrp-NMeLys-Thr-Cys)-2-Nal-NH2; Cpa-cyclo(DCys-Tyr-DTrp-NMeLys-Thr-Cys)-2-Nal-NH2; Tfm-cyclo (DCys-3-Pal-DTrp-NMeLys-Thr-Cys)-2-Nal-NH2; Cpa-cyclo(DCys-3-Pal-DTrp-NMeLys-Thr-Cys)-DTrp-NH2; Nal-cyclo (DCys-3-Pal-DTrp-NMeLys-Thr-Cys)-DTrp-NH2; 3-Pal-cyclo (DCys-3-Pal-DTrp-NMeLys-Thr-Cys)-DTrp-NH2; NmeCpa-cyclo (DCys-3-Pal-DTrp-Lys-Thr-Cys)-2-Nal-NH2; Cpa-cyclo (DCys-3-Pal-DTrp-NMeLys-Thr-Cys)-2-Nal-NH2; Cpa-cyclo(DCys-3-Pal-NMeDTrp-NMeLys-Thr-Cys)-2-Nal-NH2; Cpa-cyclo (DCys-Tyr-DTrp-NMeLys-Thr-Cys)-2-Nal-NH2; Cpa-cyclo(DCys-3-Pal-DTrp-NMeLys-Thr-Cys)-DTrp-NH2; Nal-cyclo (DCys-Pal-DTrp-NMeLys-Thr-Cys)-DTrp-NH2; or 3-Pal-cyclo(DCys-3-Pal-DTrp-NMeLys-Thr-Cys)-DTrp-NH2; NmeCpa-cyclo (DCys-3-Pal-DTrp-Lys-Thr-Cys)-2-Nal-NH2; Cpa-cyclo(DCys-3-Pal-DTrp-NMeLys-Thr-Cys)-2-Nal-NH2; Cpa-cyclo (DCys-3-Pal-NMeDTrp-NMeLys-Thr-Cys)-2-Nal-NH2; Cpa-cyclo (DCys-Tyr-DTrp-NMeLys-Thr-Cys)-2-Nal-NH2; or Cpa-cyclo(DCys-3-Pal-DTrp-NMeLys-Thr-Cys)-DTrp-NH2; Cpa-cyclo (DCys-3-Pal-DTrp-NMeLys-Thr-Cys)-2-Nal-NH2; Cpa-cyclo(DCys-Tyr-DTrp-NMeLys-Thr-Cys)-2-Nal-NH2; methylpropionic acid-Tyr-D-Trp-ys-Val-Cys-Thr-$NH_2$; methylpropionic acid-Tyr-D-Trp-ys-Val-Cys-Phe-$NH_2$;

methylpropionic acid-Tyr-D-Trp-Lys-Val-Cys-p-Cl-Phe-NH2; methylpropionic acid-Tyr-D-Trp-Lys-Val-Cys-β-Nal-$NH_2$; D-Phe-Phe-Phe-D-Trp-Lys-Thr-Phe-Thr-NH2; D-Phe-Phe-Tyr-D-Trp-Lys-val-Phe-Thr-NH2; D-Phe-p-chloro-Phe-Tyr-D-Trp-Lys-Val-Phe-Thr-$NH_2$; or D-Phe-Ala-Tyr-D-Trp-Lys-Val-Ala-β-D-Nal-$NH_2$; $H_2$-c[Cys-Phe-Phe-D-Trp-Lys-Thr-Phe-Cys]-$NH_2$, $H_2$-c[D-Cys-Phe-Phe-D-Trp-Lys-Thr-Phe-Cys]-$NH_2$, $H_2$-c[Cys-Phe-Trp-D-Trp-Lys-Ser-Phe-Cys]-$NH_2$, $H_2$-c[Cys-Phe-Phe-D-Trp-Lys-Ser-Phe-Cys]-$NH_2$, or $H_2$-c[Cys-Phe-Tyr(I)-D-Trp-Lys-Thr-Phe-Cys]-$NH_2$, $H_2$-c[Cys-Phe-Trp-D-Trp-Lys-Thr-Phe-Cys]-$NH_2$, $H_2$-c[D-Cys-Phe-Trp-D-Trp-Lys-Thr-Phe-Cys]-$NH_2$, $H_2$-c [Cys-Phe-His-D-Trp-Lys-Thr-Phe-Cys]-$NH_2$, $H_2$-c[D-Cys-Phe-His-D-Trp-Lys-Thr-Phe-Cys]-$NH_2$, $H_2$-c[D-Cys-Phe-Phe-D-Trp-Lys-Ser-Phe-Cys]-$NH_2$, $H_2$-c[D-Cys-Phe-Trp-D-Trp-Lys-Ser-Phe-Cys]-$NH_2$, $H_2$-c[Cys-Phe-His-D-Trp-Lys-Ser-Phe-Cys]-$NH_2$, $H_2$-c[D-Cys-Phe-His-D-Trp-Lys-Ser-Phe-Cys]-$NH_2$, $H_2$-c[D-Cys-Phe-Tyr(I)-D-Trp-Lys-Thr-Phe-Cys]-$NH_2$, $H_2$-c[Cys-Phe-Tyr(I)-D-Trp-Lys-Ser-Phe-Cys]-$NH_2$, or $H_2$-c[D-Cys-Phe-Tyr(I)-D-Trp-Lys-Ser-Phe-Cys]-$NH_2$, $H_2$-c[D-Cys-Asn-Phe-Phe-D-Trp-Lys-Thr-Phe-Cys]-$NH_2$, $H_2$-c[Cys-Asn-Phe-Trp-D-Trp-Lys-Thr-Phe-Cys]-$NH_2$, $H_2$-c [D-Cys-Asn-Phe-Trp-D-Trp-Lys-Thr-Phe-Cys]-$NH_2$, $H_2$-c [Cys-Asn-Phe-His-D-Trp-Lys-Thr-Phe-Cys]-$NH_2$, $H_2$-c[D-Cys-Asn-Phe-His-D-Trp-Lys-Thr-Phe-Cys]-$NH_2$, $H_2$-c[Cys-Asn-Phe-Phe-D-Trp-Lys-Ser-Phe-Cys]-$NH_2$, $H_2$-c[D-Cys-Asn-Phe-Phe-D-Trp-Lys-Ser-Phe-Cys]-$NH_2$, $H_2$-c[Cys-Asn-Phe-Trp-D-Trp-Lys-Ser-Phe-Cys]-$NH_2$, $H_2$-c[D-Cys-Asn-Phe-Trp-D-Trp-Lys-Ser-Phe-Cys]-$NH_2$, $H_2$-c [Cys-Asn-Phe-His-D-Trp-Lys-Ser-Phe-Cys]-$NH_2$, $H_2$-c [D-Cys-Asn-Phe-His-D-Trp-Lys-Ser-Phe-Cys]-$NH_2$, $H_2$-c [Cys-Asn-Phe-Tyr(I)-D-Trp-Lys-Thr-Phe-Cys]-$NH_2$, $H_2$-c [D-Cys-Asn-Phe-Tyr(I)-D-Trp-Lys-Thr-Phe-Cys]-$NH_2$, $H_2$-c [Cys-Asn-Phe-Tyr(I)-D-rp-Lys-Ser-Phe-Cys]-$NH_2$, $H_2$-c [D-Cys-Asn-Phe-Tyr(I)-D-Trp-Lys-Ser-Phe-Cys]-$NH_2$, $H_2$-c[Cys-Phe-Phe-D-Trp-Lys-Thr-Phe-Cys]-$NH_2$; Ac-D-Phe-Tyr-cyclo (D-Cys-D-Trp-Lys-Cys)-Abu-Thr-NH2; Nal-Tyr-cyclo(Cys-D-Trp-Lys-D-Cys)-Val-Nal-NH2; Nal-Tyr-cyclo(Cys-D-Trp-Lys-D-Cys)-Abu-Nal-NH2; D-Dip-Tyr-cyclo(Cys-D-Trp-Lys-D-Cys)-Abu-Nal-NH2; Dip-Tyr-cyclo (D-Cys-D-Trp-Lys-D-Cys)-Abu-Nal-$NH_2$; Nal-Tyr-cyclo(D-Cys-D-Trp-Lys-D-Cys)-Abu-Nal-NH2; Dip-Tyr-cyclo(D-Cys-D-Trp-Lys-D-Cys)-Val-Nal-NH2; Nal-Tyr-cyclo(D-Cys-D-Trp-Lys-D-Cys)-Val-Nal-NH2; cyclo(D-Phe-Tyr-cyclo(D-Cys-D-Trp-Lys-Cys)-Abu-Thr); Cpa-Pal-cyclo(D-Cys-D-Trp-Lys-D-Cys)-A3c-Nal-NH2; Cpa-Pal-cyclo(D-Cys-D-Trp-Lys-D-Gys)-A5c-Nal-NH2; Cpa-Pal-cyclo(D-Cys-D-Trp-Lys-D-Cys)-A6c-Nal-NH2; (G(z))aeg-cyclo(D-Cys-D-Trp-Lys-D-Cys)-A5c-Nal-NH2; Pal-cyclo(D-Cys-D-Trp-Lys-D-Cys)-A5c-Nal-NH2; Cpa-Pal-cyclo(D-Cys-D-Trp-Lys-D-Cys)-β-Ala-Nal-NH2; Cpa-Pal-cyclo(D-Cys-D-Trp-Lys-D-Cys)-Sar-Nal-NH2; Cpa-Pal-cyclo(D-Cys-D-Trp-Lys-D-Cys)-Gaba-Nal-NH2; Cpa-Pal-cyclo(D-Cys-D-Trp-Lys-D-Cys)-Pro-Nal-NH2; Pro-Phe-c(D-Cys-D-Trp-Lys-D-Cys)-Nle-Phe-NH2; Pro-Phe-c(D-Cys-D-Trp-Lys-D-Cys)-Thr-Nle-NH2; Pro-Phe-c (D-Cys-D-Trp-Lys-D-Cys)-Thr-Phe-NH2; Cpa-Phe-c (D-Cys-D-Trp-Lys-D-Cys)-Gaba-NH2; Cpa-Phe-c(D-Cys-D-Trp-Lys-D-Cys)-Gaba-Tyr-NH2; Pip-Phe-c (D-Cys-D-Trp-Lys-D-Cys)-NH2; Pip-Phe-c (Cys-D-Trp-Lys-Cys)-Gaba-NH2; or Pro-Phe-c(D-Cys-D-Trp-Lys-D-Cys)-Thr-NH2; Phe-cyclo(Cys-D-Trp-Lys-Cys)-Thr-NH2; Phe-Tyr-cyclo(D-Cys-D-Trp-Lys-Cys)-Abu-Thr-NH2; Ac-D-Phe-Tyr-cyclo(D-Cys-D-Trp-Lys-Cys)-Abu-Thr-NH2; Nal-Tyr-cyclo(Cys-D-Trp-Lys-D-Cys)-Val-Nal-NH2; Nal-Tyr-cyclo (Cys-D-Trp-Lys-D-Cys)-Abu-Nal-NH2; Dip-Tyr-cyclo(D-Cys-D-Trp-Lys-D-Cys)-Abu-Nal-NH2; Nal-Tyr-cyclo(D-Cys-D-Trp-Lys-D-Cys)-Abu-Nal-NH2; Dip-Tyr-cyclo (D-Cys-D-Trp-Lys-D-Cys)-Val-Nal-NH2; Nal-Tyr-cyclo(D-Cys-D-Trp-Lys-D-Cys)-Val-Nal-NH2, Cpa-Pal-cyclo(D-Cys-D-Trp-Lys-D-Cys)-A3c-Nal-NH2; Cpa-Pal-cyclo(D-Cys-D-Trp-Lys-D-Cys)-A5c-Nal-NH2; Cpa-Pal-cyclo(D-Cys-D-Trp-Lys-D-Cys)-A6c-Nal-NH2; (G(z))aeg-cyclo(D-Cys-D-Trp-Lys-D-Cys)-A5c-Nal-NH2; D-Cpa-cyclo(Cys-D-Trp-Lys-D-Cys)-A5c-Nal-NH2; Pal-cyclo (D-Cys-D-Trp-Lys-D-Cys)-A5c-Nal-NH2; Cpa-cyclo(D-Cys-D-Trp-Lys-D-Cys)-A5c-Nal-NH2; Cpa-Pal-cyclo(D-Cys-D-Trp-Lys-D-Cys)-β-Ala-Nal-NH2; Cpa-Pal-cyclo(D-Cys-D-Trp-Lys-D-Cys)-Sar-Nal-NH2; Cpa-Pal-cyclo(D-Cys-D-Trp-Lys-D-Cys)-Aic-Nal-NH2; Cpa-Pal-cyclo(D-Cys-D-Trp-Lys-D-Cys)-Gaba-Nal-NH2; Cpa-Pal-cyclo(D-Cys-D-Trp-Lys-D-Cys)-Pro-Nal-NH2; (T)aeg-cyclo(D-Cys-D-Trp-Lys-D-Cys)-(A)aeg-NH2; Cpa-Pal-cyclo(D-Cys-D-Trp-Lys-D-Cys)-A4c-Nal-NH2; Cpa-Pal-cyclo(D-Cys-D-Trp-Lys-D-Cys)-Nal-NH2; Pal-cyclo(D-Cys-D-Trp-Lys-D-Cys)-Nal-NH2; Pro-Phe-cyclo(Cys-D-Trp-Lys-D-Cys)-Val-NH2; Pro-Phe-cyclo(D-Cys-D-Trp-Lys-Cys)-Val-NH2; Pip-4-NO2-Phe-cyclo(D-cys-D-Trp-Lys-D-Cys)-Nle-NH2; (G)aeg-Pal-cyclo(D-Cys-D-Trp-Lys-D-Cys)-Thr(Bzl)-(C)aeg-NH2; or (C)aeg-Pal-cyclo(D-Cys-D-Trp-Lys-D-Cys)-Thr (Bzl)-(G) aeg-NH2; Nal-cyclo(D-Cys-Tyr-D-Trp-Lys-Cys)-Nal-NH2; D-Nal-cyclo(D-Cys-Tyr-D-Trp-Lys-Cys)-Nal-NH2; D-Phe-cyclo(Cys-Tyr-D-Trp-Lys-Cys)-Thr-NH2, D-4-NO2-Phe-cyclo(D-Cys-Tyr-D-Trp-Lys-Cys)-Nal-NH2; Ac-D-4-NO2-Phe-cyclo(D-Cys-Tyr-D-Trp-Lys-Cys)-Nal-NH2; D-4-NO2-Phe-Pal-cyclo(D-Cys-Phe (4-O-Bzl)-D-Trp-Lys-Cys)-Tyr-NH2; Cpa-cyclo(D-Cys-Pal-D-Trp-Lys-Cys)-Thr(Bzl)-Tyr-NH2; D-4-NO2-Phe-cyclo(D-Cys-Pal-D-Trp-Lys-Cys)-Thr-Tyr-NH2; D-4-NO2-Phe-cyclo(D-Cys-Pal-D-Trp-Lys-Cys)-Thr(Bzl)-NH2; D-4-NO2-Phe-cyclo (D-Cys-Pal-D-Trp-Lys-D-Cys)-Thr(Bzl)-Tyr-NH2; D-4-NO2-Phe-cyclo (D-Cys-Tyr-D-Trp-Lys-Cys)-Thr(Bzl)-Tyr-NH2; 4-NO2-Phe-cyclo(D-Cys-Pal-D-Trp-Lys-Cys)-Thr(Bzl)-Tyr-NH2; D-Nal-cyclo(D-Cys-Pal-D-Trp-Lys-Cys)-Thr(Bzl)-Tyr-NH2; Pro-cyclo(D-Cys-Pal-D-Trp-Lys-Cys)-Thr(Bzl)-Tyr-NH2; Cpa-cyclo(D-Cys-Pal-D-Trp-Lys-Cys)-Thr(Bzl)-Nal-NH2; Ser(Bzl)-cyclo(D-Cys-Pal-D-Trp-Lys-Cys)-Thr-Tyr-NH2; (T)aeg-cyclo(D-Cys-Pal-D-Trp-Lys-D-Cys)-Thr (Bzl)-Tyr-NH2; (A)aeg-cyclo(D-Cys-Pal-D-Trp-Lys-Cys)-Thr(Bzl)-Tyr-NH2; (G)aeg-cyclo(D-Cys-Pal-D-Trp-Lys-Cys)-Thr(Bzl)-Tyr-NH2; (T)aeg-cyclo(D-Cys-4-Pal-D-Trp-Lys-Cys)-Thr(Bzl)-Tyr-NH2; (T)aeg-cyclo(D-Cys-Tyr-D-Trp-Lys-Cys)-Thr(Bzl)-Tyr-NH2; (T)aeg-cyclo(D-Cys-Phe-D-Trp-Lys-Cys)-Thr(Bzl)-Tyr-NH2; (T)aeg-cyclo(D-Cys-(T)aeg-D-Trp-Lys-Cys)-Thr (Bzl)-Tyr-NH2; (T)aeg-cyclo (D-Cys-Pal-D-Trp-Lys-Cys)-Ser(Bzl)-Tyr-NH2; (T)aeg-cyclo(D-Cys-Pal-D-Trp-Lys-Cys)-Phe(4-O-Bzl)-Tyr-NH2; (T)aeg-cyclo(D-Cys-Pal-D-Trp-Lys-Cys)-A5c-Tyr-NH2; (T)aeg-cyclo(D-Cys-Pal-D-Trp-Lys-Cys)-Abu-Tyr-NH2; D-Cpa-cyclo(D-Cys-(T)aeg-D-Trp-Lys-Cys)-Thr(Bzl)-Tyr-NH2; (C)aeg-cyclo(D-Cys-Pal-D-Trp-Lys-D-Cys)-Thr (Bzl)-Tyr-NH2; D-Cpa-c(D-Cys-Pal-D-Trp-Lys-D-Cys)Thr (Bzl)-Tyr-NH2; (T)aeg-c(Pen-Pal-D-Trp-Lys-D-Cys)Thr (Bzl)-Tyr-NH2; (T)aeg-c(D-Cys-Trp-D-Trp-Lys-D-Cys)Thr (Bzl)-Tyr-NH2; (T)aeg-c(D-Cys-Phe-D-Trp-Lys-D-Cys)Thr (Bzl)-Tyr-NH2; (T)aeg-c(D-Cys-Pal-D-Trp-Orn-D-Cys)Thr (Bzl)-Tyr-NH2; (T)aeg-c(D-Cys-Pal-D-Trp-hLys-D-Cys) Thr(Bzl)-Tyr-NH2; (T)aeg-c(D-Cys-Pal-D-Trp-lamp-D-Cys)Thr(Bzl)-Tyr-NH2; (T)aeg-c(D-Cys-Pal-D-Trp-Cha(4-am)-D-Cys) Thr (Bzl)-Tyr-NH2; (T)aeg-c(D-Cys-Pal-D-Trp-Lys-D-Cys)-Ser(Bzl)-Tyr-NH2; (T)aeg-c(D-Cys-Pal-D-Trp-Lys-D-Cys)Thr(Bzl)-D-Tyr-NH2; (T)aeg-c(D-Cys-Pal-D-Trp-Lys-D-Cys) Thr (Bzl)-Trp-NH2; (T) aeg-c (D-Cys-Pal-D-Trp-Lys-D-Pen)Thr(Bzl)-Tyr-NH2; (C)aeg-c(D-Cys- Phe-D-Trp-Lys-D-Cys)Thr(Bzl)-Tyr-NH2; Ina-c(D-Cys-Phe-D-Trp-Lys-D-Cys)-Thr(Bzl)-Tyr-NH2; Ina-c(D-Cys-Phe-D-Trp-Lys-D-Cys)-Thr(Bzl)-Tyr-NH2; Inp-c(D-Cys-Phe-D-Trp-Lys-D-Cys)-thr(Bzl)-Tyr-NH2; Nua-c(D-Cys-Phe-D-Trp-Lys-D-Cys)-Thr(Bzl)-Tyr-NH2; (T)aeg-Pal-c(D-Cys-D-Trp-Lys-D-Cys)Thr(Bzl)-Tyr-NH2; (T)aeg-Pal-c(D-Cys-D-Trp-Lys-D-Cys)Tyr(Bzl)-Thr-NH2; (C)aeg-Phe-c(D-Cys-D-Trp-Lys-D-Cys) Thr(Bzl)-Tyr-NH2; or (T)aeg-D-Trp-c(D-Cys-Pal-Lys-D-Cys)Thr(Bzl)-Leu-NH2; Hca-cyclo (D-Cys-Tyr-D-Trp-Lys-Cys)-Nal-NH2; Ac-Nal-cyclo(D-Cys-Tyr-D-Trp-Lys-Cys)-Nal-NH2; Ac-D-Phe-cyclo(D-Cys-Tyr-D-Trp-Lys-Cys)-Nal-NH2; Ac-D-Nal-cyclo(D-Cys-Tyr-D-Trp-Lys-Cys)-Nal-NH2; D-Phe-cyclo(D-Cys-Tyr-D-Trp-Lys-Cys)-Nal-NH2; Nal-cyclo(D-Cys-Tyr-D-Trp-Lys-Cys)-Nal-NH2; D-Nal-cyclo(D-Cys-Tyr-D-Trp-Lys-Cys)-Nal-NH2; D-Phe-cyclo(Cys-Tyr-D-Trp-Lys-Cys)-Thr-NH2; D-4-NO2-Phe-cyclo(D-Cys-Tyr-D-Trp-Lys-Cys)-Nal-NH2; Ac-D-4-NO2-Phe-cyclo(D-Cys-Tyr-D-Trp-Lys-Cys)-Nal-NH2; D-4-NO2-Phe-Pal-cyclo(D-Cys-Phe(4-O-Bzl)-D-Trp-Lys-Cys)-Tyr-NH2; D-4-NO2-Phe-cyclo(D-Cys-Pal-D-Trp-Lys-Cys)-Thr(Bzl)-Tyr-NH2; Cpa-cyclo(D-Cys-Pal-D-Trp-Lys-Cys)-Thr(Bzl)-Tyr-NH2; D-4-NO2-Phe-cyclo(D-Cys-Pal-D-Trp-Lys-Cys)-Thr(Bzl)-NH2; D-4-NO2-Phe-cyclo(D-Cys-Pal-D-Trp-Lys-D-Cys)-Thr (Bzl)-Tyr-NH2; D-4-NO2-Phe-cyclo(D-Cys-Tyr-D-Trp-Lys-Cys)-Thr(Bzl)-Tyr-NH2; 4-NO2-Phe-cyclo(D-Cys-Pal-D-Trp-Lys-Cys)-Thr(Bzl)-Tyr-NH2; D-Nal-cyclo(D-Cys-Pal-D-Trp-Lys-Cys)-Thr (Bzl)-Tyr-NH2; Pro-cyclo(D-Cys-Pal-D-Trp-Lys-Cys)-Thr(Bzl)-Tyr-NH2; Cpa-cyclo(D-Cys-Pal-D-Trp-Lys-Cys)-Thr(Bzl)-Nal-NH2; Ser(Bzl)-cyclo(D-Cys-Pal-D-Trp-Lys-Cys)-Thr-Tyr-NH2; (T)aeg-cyclo(D-Cys-Pal-D-Trp-Lys-Cys)-Thr(Bzl)-Tyr-NH2; (C)aeg-cyclo(D-Cys-Pal-D-Trp-Lys-Cys)-Thr(Bzl)-Tyr-NH2; Aic-cyclo(D-Cys-Pal-D-Trp-Lys-Cys)-Thr(Bzl)-Tyr-NH2; (C(z))aeg-cyclo(D-Cys-Pal-D-Trp-Lys-Cys)-Thr(Bzl)-Tyr-NH2; (A(z))aeg-cyclo(D-Cys-Pal-D-Trp-Lys-Cys)-Thr(Bzl)-Tyr-NH2; (T)aeg-cyclo(D-Cys-Pal-D-Trp-Lys-D-Cys)-Thr (Bzl)-Tyr-NH2; (A)aeg-cyclo(D-Cys-Pal-D-Trp-Lys-Cys)-Thr(Bzl)-Tyr-NH2; (G)aeg-cyclo(D-Cys-Pal-D-Trp-Lys-Cys)-Thr(Bzl)-Tyr-NH2; (T)aeg-cyclo(D-Cys-4-Pal-D-Trp-Lys-Cys)-Thr(Bzl)-Tyr-NH2; (T)aeg-cyclo(D-Cys-Tyr-D-Trp-Lys-Cys)-Thr-(Bzl)-Tyr-NH2; (T)aeg-cyclo(D-Cys-Phe-D-Trp-Lys-Cys)-Thr(Bzl)-Tyr-NH2; (T)aeg-cyclo(D-Cys-(T)aeg-D-Trp-Lys-Cys)-Thr(Bzl)-Tyr-NH2; (T)aeg-cyclo(D-Cys-Pal-D-Trp-Lys-Cys)-Ser(Bzl)-Tyr-NH2; (T)aeg-cyclo(D-Cys-Pal-D-Trp-Lys-Cys)-Phe(4-O-Bzl)-Tyr-NH2; (T)aeg-cyclo(D-Cys-Pal-D-Trp-Lys-Cys)-A5c-Tyr-NH2; (T)aeg-cyclo(D-Cys-Pal-D-Trp-Lys-Cys)-Abu-Tyr-NH2; D-Cpa-cyclo(D-Cys-(T)aeg-D-Trp-Lys-Cys)-Thr (Bzl)-Tyr-NH2; (T)aeg-cyclo(D-Cys-Pal-D-Trp-Lys-D-Cys)-Thr(Bzl)-p-Me-Phe-NH2; Ac-(T)aeg-cyclo(D-Cys-Pal-D-Trp-Lys-D-Cys)-Thr(Bzl)-Tyr-NH2; (T)aeg-cyclo(D-Cys-Pal-D-Trp-Lys-D-Cys)-Nal-NH2; D-Cpa-cyclo(D-Cys-Pal-D-Trp-Lys-D-Cys)-Nal-NH2; (A)aeg-cyclo(D-Cys-Pal-D-Trp-Lys-D-Cys)-Thr(Bzl)-Tyr-NH2; (C)aeg-cyclo(D-Cys-Pal-D-Trp-Lys-D-Cys)-Thr(Bzl)-Tyr-NH2; (C)aeg-c (D-Cys-Pal-D-Trp-Lys-D-Cys)-Thr(Bzl)-Tyr-NH2; D-Cpa-c(D-Cys-Pal-D-Trp-Lys-D-Cys)Thr(Bzl)-Tyr-NH2; (T)aeg-c(Pen-Pal-D-Trp-Lys-D-Cys)Thr(Bzl)-Tyr-NH2; (T)aeg-c (D-Cys-Trp-D-Trp-Lys-D-Cys)Thr(Bzl)-Tyr-NH2; (T)aeg-c (D-Cys-Phe-D-Trp-Lys-D-Cys)Thr(Bzl)-Tyr-NH2; (T)aeg-c (D-Cys-Pal-D-Trp-Orn-D-Cys)Thr(Bzl)-Tyr-NH2; (T)aeg-c (D-Cys-Pal-D-Trp-hLys-D-Cys)Thr(Bzl)-Tyr-NH2, (T)aeg-c(D-Cys-Pal-D-Trp-lamp-D-Cys)Thr(Bzl)-Tyr-NH2; (T)aeg-c(D-Cys-Pal-D-Trp-Cha(4-am)-D-Cys)Thr(Bzl)-Tyr-NH2; (T)aeg-c(D-Cys-Pal-D-Trp-Lys-D-Cys)-Ser(Bzl)-Tyr-NH2; (T)aeg-c (D-Cys-Pal-D-Trp-Lys-D-Cys)Thr (Bzl)-D-Tyr-NH2; (T)aeg-c (D-Cys-Pal-D-Trp-Lys-D-Cys)Thr (Bzl)-Trp-NH2; (T)aeg-c(D-Cys-Pal-D-Trp-Lys-D-Pen)Thr (Bzl)-Tyr-NH2; (C)aeg-c(D-Cys-Phe-D-Trp-Lys-D-Cys)Thr (Bzl)-Tyr-NH2; Ina-c(D-Cys-Phe-D-Trp-Lys-D-Cys)-Thr (Bzl)-Tyr-NH2; Mnf-c(D-Cys-Phe-D-Trp-Lys-D-Cys)-Thr (Bzl)-Tyr-NH2; Inp-c(D-Cys-Phe-D-Trp-Lys-D-Cys)-Thr (Bzl)-Tyr-NH2; Nua-c(D-Cys-Phe-D-Trp-Lys-D-Cys)-Thr (Bzl)-Tyr-NH2; (T)aeg-Pal-c(D-Cys-D-Trp-Lys-D-Cys)Thr (Bzl)-Tyr-NH2; (T)aeg-Pal-c(D-Cys-D-Trp-Lys-D-Cys)Tyr (Bzl)-Thr-NH2; (C)aeg-Phe-c(D-Cys-D-Trp-Lys-D-Cys) Thr(Bzl)-Tyr-NH2; or (T)aeg-D-Trp-c(D-Cys-Pal-Lys-D-Cys)Thr(Bzl)-Leu-NH2; cyclo(Trp-D-Trp-Lys-Phe(4-O-Bzl)-Phe-(T)aeg); cyclo(Trp-D-Trp-Lys-Pal-Phe-(T)aeg); cyclo(Phe-Phe-D-Trp-Lys-Thr-(T)aeg); or H-β-D-Nal-Cys-Tyr-D-Trp-Lys-Val-Cys-Thr-NH2 (also known as lanreotide) cyclo(Pro-Phe-D-Trp-Lys-Thr-Phe), cyclo(N-Me-Ala-Tyr-D-Trp-Lys-Val-Phe); D-beta-Nal-Cys-Tyr-D-Trp-Lys-Val-Cys-Thr-$NH_2$; D-Phe-Cys-Tyr-D-Trp-Lys-Val-Cysbeta-Nal-$NH_2$; D-Phe-Cys-Tyr-D-Trp-Lys-α-Aminobutyric acid-Cys-Thr-$NH_2$; pentafluoro-D-Phe-Cys-Tyr-D-Trp-Lys-Val-Cys-Thr-$NH_2$; N-Ac-D-beta-Nal-Cys-Tyr-D-Trp-Lys-Val-Cys-Thr-$NH_2$; D-beta-Nal-Cys-pentafluoro-Phe-D-Trp-Lys-Val-Cys-Thr-$NH_2$; D-/3-Nal-Cys-Tyr-D-Trp-Lys-Val-Cys-beta-Nal-$NH_2$; D-Phe-Cys-/3-Nal-D-Trp-Lys-Val-Cys-Thr-$NH_2$; D-beta-Nal-Cys-Tyr-D-Trp-Lys-α-aminobutyric acid-Cys-Thr-$NH_2$; D-p-Cl-Phe-Cys-Tyr-D-Trp-Lys-α-aminobutyric acid-Cys-Thr-$NH_2$; acetyl-D-p-Cl-Phe-Cys-Tyr-D-Trp-Lys-α-aminobutyric acid-Cys-Thr-$NH_2$; cyclo(Pro-Phe-D-Trp-Lys-Thr-Phe); cyclo(N-Me-Ala-Tyr-D-Trp-Lys-Val-Phe); D-beta-Nal-Cys-Tyr-D-Trp-Lys-Val-Cys-Thr-$NH_2$; D-Phe-Cys-Tyr-D-Trp-Lys-Val-Cys-Trp-$NH_2$; D-Phe-Cys-Phe-D-Trp-Lys-Thr-Cys-Thr(ol); D-p-Cl-Phe-Cys-Tyr-D-Trp-Lys-Val-Cys-Thr-$NH_2$; D-Phe-Cys-Tyr-D-Trp-Lys-Val-Cys-beta-Nal; H2-beta-Nal-D-Cys-Tyr-D-Trp-Lys-Val-Cys-beta-Nal-NH2; (H)(CH3CO)-beta-Nal-D-Cys-Tyr-D-Trp-Lys-Val-Cys-beta-Nal-NH2; (H)-(4-(2-hydroxyethyl)-1-piperazinylacetyl)-beta-Nal-D-Cys-Tyr-D-Trp-Lys-Val-Cys-beta-Nal-NH2; (H)-(4-(2-hydroxyethyl)-1-piperizineethanesulfonyl)-beta-Nal-D-Cys-Tyr-D-Trp-Lys-Val-Cys-beta-Nal-NH2; H2-beta-Nal-D-Cys-Pal-D-Trp-Lys-Val-Cys-beta-Nal-NH2; (H)(CH3CO)-beta-Nal-D-Cys-Pal-D-Trp-Lys-Val-Cys-beta-Nal-NH2; (H)-(4-(2-hydroxyethyl)-1-piperazinylacetyl)-beta-Nal-D-Cys-Pal-D-Trp-Lys-Val-Cys-beta-Nal-NH2; (H)-(4-(2-hydroxyethyl)-1-piperizineethanesulfonyl)-beta-Nal-D-Cys-Pal-D-Trp-Lys-Val-Cys-beta-Nal-NH2; H2-beta-Nal-D-Cys-Tyr-D-Trp-Lys-Val-Cys-Thr-NH2; (H)(CH3CO)-beta-Nal-D-Cys-Tyr-D-Trp-Lys-Val-Cys-Thr-NH2; (H)(4-(2-hydroxyethyl)-1-piperazinylacetyl)-beta-Nal-D-Cys-Tyr-D-Trp-Lys-Val-Cys-Thr-NH2; (H)(4-(2-hydroxyethyl)-1-piperizineethanesulfonyl)-beta-Nal-D-Cys-Tyr-D-Trp-Lys-Val-Cys-Thr-NH2; H2-beta-Nal-D-Cys-Pal-D-Trp-Lys-Val-Cys-Thr-NH2; (H)(CH3CO)-beta-Nal-D-Cys-Pal-D-Trp-Lys-Val-Cys-Thr-NH2; (H)(4-(2-hydroxyethyl)-1-piperazinylacetyl)-beta-Nal-D-Cys-Pal-D-Trp-Lys-Val-Cys-Thr-NH2; (H)(4-(2-hydroxyethyl)-1-piperizineethanesulfonyl)-0-Nal-D-Cys-Pal-D-Trp-Lys-Val-Lys-Thr-NH2; H2-Phe-D-Cys-Tyr-D-Trp-Lys-Val-Cys-beta-Nal-NH2; (H)(CH3CO)Phe-D-Cys-Tyr-D-Trp-Lys-Val-Cys-beta-Nal-NH2; (H)(4-(2-hydroxyethyl)-1-piperazinylacetyl)-Phe-D-Cys-Tyr-D-Trp-Lys-Val-Cys-beta-Nal-NH2; (H)(4-(2-hydroxyethyl)-1-piperizineethanesulfonyl)-Phe-D-Cys-Tyr-D-Trp-Lys-Val-Cys-beta-Nal-NH2; H2-Phe-D-Cys-Pal-D-Trp-Lys-Val-Cys-beta-Nal-NH2; (H)(CH3CO)Phe-D-Cys-Pal-D-Trp-Lys-Val-Cys-beta-Nal-NH2; (H)(4-(2hydroxyethyl)-1-piperazinylacetyl)-Phe-D-Cys-Pal-D-Trp-Lys-Val-Cysbeta-Nal-NH2; (H)(4-(2-hydroxyethyl)-1-piperizineethanesulfonyl)-Phe-D-Cys-Pal-D-Trp-Lys-Val-Cys-beta-Nal-NH2; H2-Phe-D-Cys-Pal-D-Trp-Lys-Val-Cys-Thr-NH2; (H)(CH3CO)-Phe-D-Cys-Pal-D-Trp-Lys-Val-Cys-Thr-NH2; (H)(4-(2-hydroxyethyl)-1-piperazinylacetyl)-Phe-D-Cys-Pal-D-Trp-Lys-Val-Cys-Thr-NH2; (H)(4-(2-hydroxyethyl)-1-piperizineethanesulfonyl)-Phe-D-Cys-Pal-D-Trp-Lys-Val-Cys-Thr-NH2; H2-beta-Nal-D-Cys-Tyr-D-Trp-Lys-Thr-Cys-beta-Nal-NH2; (H)(CH3CO)-beta-Nal-D-Cys-Pal-D-Trp-Lys-Thr-Cys-beta-Nal-NH2; (H)(4-(2-hydroxyethyl)-1-piperazinylacetyl)-beta-Nal-D-Cys-Tyr-D-Trp-Lys-Thr-Cys-beta-Nal-NH2; (H)(4-(2-hydroxyethyl)-1-piperizineethanesulfonyl)-beta-Nal-D-Cys-Tyr-D-Trp-Lys-Thr-Cys-beta-Nal-NH2; H2-beta-Nal-D-Cys-Pal-D-Trp-Lys-Thr-Cys-beta-Nal-NH2; (H)(CH3CO)-beta-Nal-D-Cys-Pal-D-Trp-Lys-Thr-Cys-beta-Nal-NH2; (H)(4-(2-hydroxyethyl)-1-piperazinylacetyl)-beta-Nal-D-Cys-Pal-D-Trp-Lys-Thr-Cys-beta-Nal-NH2; (H)(4-(2-hydroxyethyl)-1-piperizineethanesulfonyl)-beta-Nal-D-Cys-Pal-D-Trp-Lys-Thr-Cys-beta-Nal-NH2; H2-beta-Nal-D-Cys-Tyr-D-Trp-Lys-Thr-Cys-Thr-NH2; H(CH3CO)-beta-Nal-D-Cys-Tyr-D-Trp-Lys-Thr-Cys-Thr-NH2; (H)(4-(2-hydroxyethyl)-1-piperazinylacetyl)-beta-Nal-D-Cys-Tyr-D-Trp-Lys-Thr-Cys-Thr-NH2; (H)(4-(2-hydroxyethyl)-1-piperizineethanesulfonyl)-beta-Nal-D-Cys-Tyr-D-Trp-Lys-Thr-Cys-Thr-NH2; H2-beta-Nal-D-Cys-Pal-D-Trp-Lys-Thr-Cys-Thr-NH2; (H)(CH3CO)-beta-Nal-D-Cys-Pal-D-Trp-Lys-Thr-Cys-Thr-NH2; (H)(4-(2-hydroxyethyl)-1-piperazinylacetyl)-beta-Nal-D-Cys-Pal-D-Trp-Lys-Thr-Cys-Thr-NH2; (H)(4-(2-hydroxyethyl)-1-piperizineethanesulfonyl)-beta-Nal-D-Cys-Pal-D-Trp-Lys-Thr-Cys-Thr-NH2; H2-Phe-D-Cys-Tyr-D-Trp-Lys-Thr-Cys-beta-Nal-NH2; (H)(CH3CO)Phe-D-Cys-Tyr-D-Trp-Lys-Thr-Cys-beta-Nal-NH2; (H)(4-(2-hydroxyethyl)-1-piperazinylacetyl)Phe-D-Cys-Tyr-D-Trp-Lys-Thr-Cys-beta-Nal-NH2; (H)(4-(2-hydroxyethyl)-1-piperizineethanesulfonyl)Phe-D-Cys-Tyr-D-Trp-Lys-Thr-Cys-beta-Nal-NH2; H2-Phe-D-Cys-Pal-D-Trp-Lys-Thr-Cys-beta-Nal-NH2; (H)(CH3CO)Phe-D-Cys-Pal-D-Trp-Lys-Thr-Cys-beta-Nal-NH2; (H)(4-(2-hydroxyethyl)-1-piperazinylacetyl)Phe-D-Cys-Pal-D-Trp-Lys-Thr-Cys-beta-Nal-NH2; (H)(4-(2-hydroxyethyl)-1-piperizineethanesulfonyl)Phe-D-Cys-Pal-D-Trp-Lys-Thr-Cys-beta-Nal-NH2; H2-Phe-D-Cys-Tyr-D-Trp-Lys-Thr-Cys-Thr-NH2; (H)(CH3CO)Phe-D-Cys-Tyr-D-Trp-Lys-Thr-Cys-Thr-NH2; (H)(4-(2-hydroxyethyl)-1-piperazinylacetyl)Phe-D-Cys-Tyr-D-Trp-Lys-Thr-Cys-Thr-NH2; (H)(4-(2-hydroxyethyl)-1-piperizineethanesulfonyl) Phe-D-Cys-Tyr-D-Trp-Lys-Thr-Cys-Thr-NH2; H2-Phe-D-Cys-Pal-D-Trp-Lys-Thr-Cys-Thr-NH2; (H)(CH3CO)-Phe-D-Cys-Pal-D-Trp-Lys-Thr-Cys-Thr-NH2; (H)(4-(2-hydroxyethyl)-1-piperazinylacetyl)Phe-D-Cys-Pal-D-Trp-Lys-Thr-Cys-Thr-NH2; (H)(4-(2-hydroxyethyl)-1-piperizineethanesulfonyl)Phe-D-Cys-Pal-D-Trp-Lys-Thr-Cys-Thr-NH2; H2-beta-Nal-D-Cys-Tyr-D-Trp-Lys-Abu-Cys-beta-Nal-NH2; H2-Phe-D-Cys-Tyr-D-Trp-Lys-Abu-Cys-beta-Nal-NH2; H2-beta-Nal-D-Cys-Pal-D-Trp-Lys-Abu-Cys-beta-Nal-NH2; H2-Phe-D-Cys-Pal-D-Trp-Lys-Abu-Cys-beta-Nal-NH2; H2-beta-Nal-D-Cys-Tyr-D-Trp-Lys-Abu-Cys-Thr-NH2; H2-Phe-D-Pen-Tyr-D-Trp-Lys-Val-Pen-beta-Nal-NH2; H2-Phe-D-Pen-Pal-D-Trp-Lys-Thr-Pen-Thr-NH2; H2-Dip-D-Cys-Pal-D-Trp-Lys-Val-Cys-Dip-NH2; H2-F5-Phe-D-Cys-His-D-Trp-Lys-Val-Cys-F5-Phe-NH2; H2-Dip-D-Cys-Pal-D-Trp-Lys-Val-Cys-beta-Nal-NH2; H2-m-F-Phe-D-Cys-Pal-D-Trp-Lys-Val-Cys-m-F-Phe-NH2 H2-o-F-Phe-D-Cys-Pal-D-Trp-Lys-Val-Cys-o-F-Phe-NH2; H2-p-F-Phe-D-Cys-Pal-D-Trp-Lys-Val-Cys-p-F-Phe-NH2; H2-F5-Phe-D-Cys-Pal-D-Trp-Lys-Val-Cys-F5-Phe-NH2; H2-F5-Phe-D-Cys-2-Pal-D-Trp-Lys-Val-Cys-F5-Phe-NH2; H2-beta-Nal-D-Cys-His-D-Trp-Lys-Val-Cys-D-Dip-NH2; H2-Dip-D-Cys-His-D-Trp-Lys-Val-Cys-beta-Nal-NH2; H2-Dip-D-Cys-His-D-Trp-Lys-Val-Cys-Dip-NH2; H2-beta-Nal-D-Cys-His-D-Trp-Lys-Val-Cys-beta-Nal-NH2; H2-Trp-D-Cys-Tyr-D-Trp-Lys-Val-Cys-D-beta-Nal-NH2; H2-beta-Nal-D-Cys-Tyr-D-Trp-Lys-Val-Cys-D-beta-Nal-NH2; H2-beta-Nal-D-Cys-Pal-D-Trp-Lys-Val-Cys-D-p-F-Phe-NH2; H2-beta-Nal-D-Cys-Pal-D-Trp-Lys-Tle-Cys-beta-Nal-NH2; H2-p-F-Phe-D-Cys-Pal-D-Trp-Lys-Val-Cys-beta-Nal-NH2; H2-beta-Nal-D-Cys-Pal-D-Trp-Lys-Nle-Cys-beta-Nal-NH2; H2-beta-Nal-D-Cys-Pal-D-Trp-Lys-Ile-Cys-beta-Nal-NH2; H2-beta-Nal-D-Cys-Pal-D-Trp-Lys-Gly-Cys-beta-Nal-NH2; H2-beta-Nal-D-Cys-Pal-D-Trp-Lys-Ala-Cys-beta-Nal-NH2; H2-beta-Nal-D-Cys-Pal-D-Trp-Lys-Leu-Cys-beta-Nal-NH2; H2-Bip-D-Cys-Tyr-D-Trp-Lys-Ile-Cys-Bip-NH2; H2-p-F-Phe-D-Cys-His-D-Trp Lys-Val-Cys-p-F-Phe-NH2; H2-Npa-D-Cys-Pal-D-Trp-Lys-Val-Cys-Tyr-NH2; H2-m-F-Phe-D-Cys-His-D-Trp-Lys-Val-Cys-m-F-Phe-NH2; H2-o-F-Phe-D-Cys-His-D-Trp-Lys-Val-Cys-o-F-Phe-NH2; H2-beta-Nal-D-Cys-Pal-D-Trp-Lys-Val-Cys-Dip-NH2; H2-Cpa-D-Cys-Pal-D-Trp-Lys-Val-Cys-Cpa-NH2; H2-Igl-D-Cys-Pal-D-Trp-Lys-Val-Cys-Igl-NH2; H2-beta-Nal-D-Cys-Pal-D-Trp-Lys-Val-Cys-D-Dip-NH2; H2-beta-Nal-D-Cys-3-I-Tyr-D-Trp-Lys-Val-Cys-beta-Nal-NH2; H2-p-CN-Phe-D-Cys-Pal-D-Trp-Lys-Val-Cys-p-CN-Phe-NH2; H2-beta-Nal-D-Cys-Tyr-D-Trp-Lys-Val-Cys-D-Dip-NH2; H2-beta-Nal-D-Cys-Bta-D-Trp-Lys-Val-Cys-beta-Nal-NH2; H2-p-F-Phe-D-Cys-Pal-D-Trp-Lys-Tle-Cys-beta-Nal-NH2; H2-Bpa-D-Cys-Pal-D-Trp-Lys-Val-Cys-Bpa-NH2; H2-Iph-D-Cys-Pal-D-Trp-Lys-Val-Cys-Iph-NH2; H2-Trp-D-Cys-Pal-D-Trp-Lys-Tle-Cys-beta-Nal-NH2; H2-p-Cl-Phe-D-Cys-Pal-D-Trp-Lys-Val-Cys-beta-Nal-NH2; H2-p-Cl-Phe-D-Cys-Pal-D-Trp-Lys-Tle-Cys-beta-Nal-NH2; H2-p-Cl-Phe-D-Cys-Pal-D-Trp-Lys-Tle-Cys-p-Cl-Phe-NH2; H2-p-Cl-Phe-D-Cys-Pal-D-Trp-Lys-Cha-Cys-p-Cl-Phe-NH2; H2-p-Cl-Phe-D-Cys-Tr(I)-D-Trp-Lys-Val-Cys-p-Cl-Phe-NH2; H2-p-Cl-Phe-D-Cys-Tyr(I)-D-Trp-Lys-Val-Cys-beta-Nal-NH2; H2-p-Cl-Phe-D-Cys-Tyr(I)-D-Trp-Lys-Tle-Cys-beta-Nal-NH2; H2-p-F-Phe-D-Cys-Tyr(I)-D-Trp-Lys-Val-Cys-beta-Nal-NH2; H2-p-F-Phe-D-Cys-Tyr(I)-D-Trp-Lys-Tle-Cys-beta-Nal-NH2; H2-beta-Nal-D-Cys-Tyr-D-Trp-Lys-Abu-Cys-beta-Nal-NH2; (H)(CH3CO)-beta-Nal-D-Cys-Tyr-D-Trp-Lys-Abu-Cys-beta-Nal-NH2; H2-p-N02-Phe-D-Cys-Tyr-D-Trp-Lys-Abu-Cys-beta-Nal-NH2; (H)(CH3CO)-beta-Nal-D-Cys-Tyr-D-Trp-Lys-Abu-Cys-beta-Nal-NH2; H2-p-N02-Phe-D-Cys-Tyr(Bzl)-D-Trp-Lys-Thr(Bzl)-Cys-Nal-NH2; (H)(4-(2-hydroxyethyl)-1-piperazinylacetyl)-p-NO2-Phe-D-Cys-Tyr(Bzl)-D-Trp-Lys-Thr(Bzl)-Cys-beta-Nal-NH2; (H)(4-(2-hydroxyethyl)-1-piperazinylacetyl)-p-NO2-Phe-D-Cys-Tyr-D-Trp-Lys-Thr-Cys-Tyr-NH2; H2-p-NO2-Phe-D-Cys-Tyr-D-Trp-Lys-Val-Cys-beta-Nal-NH2; (H)(4-(2-hydroxyethyl)-1-piperazinylacetyl)-p-NO2-Phe-D-Cys-Tyr-D-Trp-Lys-Val-Cys-P-Nal-NH2; (H)(4-(2-hydroxyethyl)-1-piperazinylacetyl)-beta-Nal-Phe-D-Cys-Tyr-D-Trp-Lys-Val-Cys-beta-Nal-NH2; H2-beta-Nal-D-Cys-Tyr(Bzl)-D-Trp-Lys-Thr(Bzl)-Cys-beta-Nal-NH2; (H)(4-(2-hydroxyethyl)-1-piperazinylacetyl)-beta-Nal-D-Cys-Tyr(Bzl)-D-Trp-Lys-Thr(Bzl)-Cys-Tyr(Bzl)-NH2; H2-D-Phe-D-Pen-Tyr-D-Trp-Lys-Val-Cys-Thr-NH2; H2-D-beta-Nal-D-Cys-Tyr-D-Trp-Lys-Val-Cys-Thr-NH2; H2-D-beta-Nal-D-Cys-Tyr-D-Trp-Lys-Val-Cys-beta-Nal-NH2; H2-D-beta-Nal-D-Cys-Tyr-D-Trp-Lys-Thr-Cys-beta-Nal-NH2; H2-D-Phe-D-Cys-Pal-D-Trp-Lys-Thr-Cys-Thr-NH2; H2-D-Phe-D-Cys-Tyr-D-Trp-Lys-Abu-Cys-Thr-NH2; H2-D-beta-Nal- D-Cys-Tyr-D-Trp-Lys-Abu-Cys-Thr-NH2; H2-D-beta-Nal-D-Cys-Tyr-D-Trp-Lys-Val-Cys-D-beta-Nal-NH2; H2-D-p-F-Phe-D-Cys-Pal-D-Trp-Lys-Val-Cys-D-p-F-Phe-NH2; H2-D-Bip-D-Cys-Tyr-D-Trp-Lys-Val-Cys-beta-Nal-NH2; H2-D-Dip-D-Cys-Pal-D-Trp-Lys-Val-Cys-beta-Nal-NH2; H2-D-p-F-Phe-D-Cys-Pal-D-Trp-Lys-Tle-Cys-beta-Nal-NH2; H2-D-p-Cl-Phe-D-Cys-Pal-D-Trp-Lys-Tle-Cys-p-Cl-Phe-NH2; p-N02-D-Phe-D-Cys-Pal-D-Trp-Lys-Thr(Bzl)-Cys-Tyr(Bzl)-NH2; p-N02-D-Phe-D-Cys-Tyr(Bzl)-D-Trp-Lys-Val-Cys-Tyr(Bzl)-NH2; (H)(4-(2-hydroxyethyl)-1-piperazinylacetyl)-p-NO2-P-Phe-D-Cys-Pal-D-Trp-Lys-Thr (Bzl)-Cys-Tyr(Bzl)-NH2; (H)(4-(2-hydroxyethyl)-1-piperazinylacetyl)-p-NO2-P-Phe-D-Cys-Tyr(Bzl)-D-Trp-Lys-Val-Cys-Tyr(Bzl)-NH2; (H) (5-phenylpropionyl)-D-Cys-Tyr-D-Trp-Lys-Val-Cys-beta-Nal-NH2; (H)(3-phenylpropronyl)-D-Cys-Pal-D-Trp-Lys-Val-Cys-beta-Nal-NH2; (H)(3-phenylpropronyl)-D-Cys-Tyr-D-Trp-Lys-Thr-Cys-beta-Nal-NH2; (H)(3-phenylpropronyl)-D-Cys-Pal-D-Trp-Lys-Thr-Cys-beta-Nal-NH2; (H)(3-phenylpropionyl)-D-Cys-Tyr-D-Trp-Lys-Val-Cys-Thr-NH2; (H)(3-phenylpropionyl)-D-Cys-Pal-D-Trp-Lys-Val-Cys-Thr-NH2; (H)(3-phenylpropionyl)-D-Cys-Tyr-D-Trp-Lys-Thr-Cys-Thr-NH2; (H)(3-phenylpropionyl)-D-Cys-Pal-D-Trp-Lys-Thr-Cys-Thr-NH2; (H)(3-[2-naphthyl]propionyl)-D-Cys-Tyr-D-Trp-Lys-Val-Cys-beta-Nal-NH2; (H)(3-[2-naphthyl] propionyl)-D-Cys-Pal-D-Trp-Lys-Val-Cys-beta-Nal-NH2; (H)(3-[2-naphthyl]propionyl)-D-Cys-Tyr-D-Trp-Lys-Thr-Cys-beta-Nal-NH2; (H)(3-[2-naphthyl]propionyl)-D-Cys-Pal-D-Trp-Lys-Thr-Cys-beta-Nal-NH2; (H)(3-[2-naphthyl] propionyl)-D-Cys-Tyr-D-Trp-Lys-Val-Cys-Thr-NH2; (H)(3-[2-naphthyl]propionyl)-D-Cys-Pal-D-Trp-Lys-Val-Cys-Thr-NH2; (H)(3-[2-naphthyl]propionyl)-D-Cys-Tyr-D-Trp-Lys-Thr-Cys-Thr-NH2; (H)(3-[2-naphthyl]propionyl)-D-Cys-Pal-D-Trp-Lys-Thr-Cys-Thr-NH2; (H)(3-[p-hydroxyphenyl])-D-Cys-Tyr-D-Trp-Lys-Val-Cys-beta-Nal-NH2; (H)(3-naphthyl]propionyl)-D-Cys-Tyr-D-Trp-Lys-Abu-Cys-beta-Nal-NH2; (H)(3-naphthyl]propionyl)-D-Cys-Tyr-D-Trp-Lys-Abu-Cys-Thr-NH2; (H)(3-phenylylpropionyl)-D-Cys-Tyr-D-Trp-Lys-Abu-Cys-beta-Nal-NH2; or (H)(3-phenylylpropionyl)-D-Cys-Tyr-D-Trp-Lys-Abu-Cys-Thr-NH2; H2-beta-Nal-D-Cys-Tyr-D-Trp-Lys-Val-Cys-2R,3R-(2-hydroxymethyl)-3-hydroxy) propylamide; (H)(CH3CO)-beta-Nal-D-Cys-Tyr-D-Trp-Lys-Val-Cys-2R,3R-(2-hydroxymethyl)-3-hydroxy) propylamide; (H)(4-(2-hydroxyethyl)-1-piperazinylacetyl)-beta-Nal-D-Cys-Tyr-D-Trp-Lys-Val-Cys-2R,3R-(2-hydroxymethyl)-3-hydroxy)propylamide; (H)(4-(2-hydroxyethyl)-1-piperizineethanesulfonyl)-beta-Nal-D-Cys-Tyr-D-Trp-Lys-Val-Cys-2R,3R-(2-hydroxymethyl)-3-hydroxy)propylamide; H2-beta-Nal-D-Cys-Pal-D-Trp-Lys-Val-Cys-2R,3R-(2-hydroxymethyl)-3-hydroxy) propylamide; (H)(CH3CO)-beta-Nal-D-Cys-Pal-D-Trp-Lys-Val-Cys-2R,3R-(2-hydroxymethyl)-3-hydroxy) propylamide; (H)(4-(2-hydroxyethyl)-1-piperazinylacetyl)-beta-Nal-D-Cys-Pal-D-Trp-Lys-Val-Cys-2R,3R-(2-hydroxymethyl)-3-hydroxy)propylamide; (H)(4-(2-hydroxyethyl)-1-piperizineethanesulfonyl)-beta-Nal-D-Cys-Pal-D-Trp-Lys-Val-Cys-2R,3R-(2-hydroxymethyl)-3-hydroxy)propylamide; H2-beta-Nal-D-Cys-Tyr-D-Trp-Lys-Thr-Cys-2R,3R-(2-hydroxymethyl)-3-hydroxy) propylamide; (H)(CH3CO)-beta-Nal-D-Cys-Tyr-D-Trp-Lys-Thr-Cys-2R,3R-(2-hydroxymethyl)-3-hydroxy) propylamide; (H)(4-(2-hydroxyethyl)-1-piperazinylacetyl)-beta-Nal-D-Cys-Tyr-D-Trp-Lys-Thr-Cys-2R,3R-(2-hydroxymethyl)-3-hydroxy)propylamide; (H)(4-(2-hydroxyethyl)-1-piperizineethanesulfonyl)-beta-Nal-D-Cys-Tyr-D-Trp-Lys-Thr-Cys-2R,3R-(2-hydroxymethyl)-3-hydroxy)propylamide; H2-beta-Nal-D-Cys-Pal-D-Trp-Lys-Thr-Cys-2R,3R-(2-hydroxymethyl)-3-hydroxy)propylamide; (H)(CH3CO)-beta-Nal-D-Cys-Pal-D-Trp-Lys-Thr-Cys-2R,3R-(2-hydroxymethyl)-3-hydroxy)propylamide; (H)(4-(2-hydroxyethyl)-1-piperazinylacetyl)-beta-Nal-D-Cys-Pal-D-Trp-Lys-Thr-Cys-2R,3R-(2-hydroxymethyl)-3-hydroxy)propylamide; (H)(4-(2-hydroxyethyl)-1-piperizineethanesulfonyl)-beta-Nal-D-Cys-Pal-D-Trp-Lys-Thr-Cys-2R,3R-(2-hydroxymethyl)-3-hydroxy)propylamide; H2-Phe-D-Cys-Tyr-D-Trp-Lys-Val-Cys-2R,3R-(2-hydroxymethyl)-3-hydroxy)propylamide; (H)(CH3CO)Phe-D-Cys-Tyr-D-Trp-Lys-Val-Cys-2R,3R-(2-hydroxymethyl)-3-hydroxy)propylamide; (H)(4-(2-hydroxyethyl)-1-piperazinylacetyl)Phe-D-Cys-Tyr-D-Trp-Lys-Val-Cys-2R,3R-(2-hydroxymethyl)-3-hydroxy)propylamide; (H)(4-(2-hydroxyethyl)-1-piperizineethanesulfonyl) Phe-D-Cys-Tyr-D-Trp-Lys-Val-Cys-2R,3R-(2-hydroxymethyl)-3-hydroxy) propylamide; H2-Phe-D-Cys-Pal-D-Trp-Lys-Val-Cys-2R,3R-(2-hydroxymethyl)-3-hydroxy)propylamide; H(CH3CO)Phe-D-Cys-Pal-D-Trp-Lys-Val-Cys-2R,3R-(2-hydroxymethyl)-3-hydroxy)propylamide; (H)(4-(2-hydroxyethyl)-1-piperazinlylacetyl)Phe-D-Cys-Pal-D-Trp-Lys-Val-Cys-2R,3R-(2-hydroxymethyl)-3-hydroxy) propylamide; (H)(4-(2-hydroxyethyl)-1-piperizineethanesulfonyl) Phe-D-Cys-Pal-D-Trp-Lys-Val-Cys-2R,3R-(2-hydroxymethyl)-3-hydroxy)propylamide; H2-Phe-D-Cys-Tyr-D-Trp-Lys-Thr-Cys-2R,3R-(2-hydroxymethyl)-3-hydroxy)propylamide; (H)(CH3CO)Phe-D-Cys-Tyr-D-Trp-Lys-Thr-Cys-2R,3R-(2-hydroxymethyl)-3-hydroxy)propylamide; (H)(4-(2-hydroxyethyl)-1-piperazinylacetyl)Phe-D-Cys-Tyr-D-Trp-Lys-Thr-Cys-2R,3R-(2-hydroxymethyl)-3-hydroxy)propylamide; (H)(4-(2-hydroxyethyl)-1-piperizineethanesulfonyl)Phe-D-Cys-Tyr-D-Trp-Lys-Thr-Cys-2R,3R-(2-hydroxymethyl)-3-hydroxy) propylamide; H2-Phe-D-Cys-Pal-D-Trp-Lys-Thr-Cys-2R,3R-(2-hydroxymethyl)-3-hydroxy)propylamide; (H) (CH3CO)Phe-D-Cys-Pal-D-Trp-Lys-Thr-Cys-2R,3R-(2-hydroxymethyl)-3-hydroxy)propylamide; (H)(4-(2-hydroxyethyl)-1-piperazinylacetyl)Phe-D-Cys-Pal-D-Trp-Lys-Thr-Cys-2R,3R-(2-hydroxymethyl)-3-hydroxy) propylamide; (H)(4-(2-hydroxyethyl)-1-piperizineethanesylfonyl)Phe-D-Cys-Pal-D-Trp-Lys-Thr-Cys-2R,3R-(2-hydroxymethyl)-3-hydroxy)propylamide; H2-beta-Nal-D-ys-Tyr-D-Trp-Lys-Val-Cys-2R-(2-naphthyl) ethylamide; (H)(CH3CO)-beta-Nal-D-Cys-Tyr-P-Trp-Lys-Val-Cys-2R-(2-naphthyl)ethylamide; (H)(4-(2-hydroxyethyl)-1-piperazinylacetyl)-beta-Nal-D-Cys-Tyr-D-Trp-Lys-Val-Cys-2R-(2-naphthyl)ethylamide; (H)(4-(2-hydroxyethyl)-1-piperizineethanesulfonyl)-D-Nal-D-Cys-Tyr-D-Trp-Lys-Val-Cys-2R-(2-naphthyl)ethylamide; H2-beta-Nal-D-Cys-Pal-D-Trp-Lys-Val-Cys-2R-(2-naphthyl)ethylamide; (H)(CH,CO)-beta-Nal-D-Cys-Pal-D-Trp-Lys-Val-Cys-2R-(2-naphthyl)ethylamide; (H)(4-(2-hydroxyethyl)-1-piperazinylacetyl)-beta-Nal-D-Cys-Pal-D-Trp-Lys-Val-Cys-2R-(2-naphthyl)ethylamide; (H)(4-(2-hydroxyethyl)-1-piperizineethanesulfonyl)-beta-Nal-D-Cys-Pal-D-Trp-Lys-Val-Cys-2R-(2-naphthyl)ethylamide; H2-beta-Nal-D-Cys-Tyr-D-Trp-Lys-Thr-Cys-2R-(2-naphthyl)ethylamide; (H)(CH,CO)-beta-Nal-D-Cys-Tyr-D-Trp-Lys-Thr-Cys-2R-(2naphthyl)ethylamide; (H)(4-(2-hydroxyethyl)-1-piperazinylacetyl)-beta-Nal-D-Cys-Tyr-D-Trp-Lys-Thr-Cys-2R-(2-naphthyl)ethylamide; (H)(4-(2-hydroxyethyl)-1-piperizineethanesulfonyl)-beta-Nal-D-Cys-Tyr-D-Trp-Lys-Thr-Cys-2R-(2-naphthyl)ethylamide; H2-beta-Nal-D-Cys-Pal-D-Trp-Lys-Thr-Cys-2R-(2-naphthyl)ethylamide; (H)(CH3CO)-beta-Nal-D-Cys-Pal-D-Trp-Lys-Thr-Cys-2R-(2-naphthyl)ethylamide; (H)(4-(2-hydroxyethyl)-1-piperazinylacetyl)-beta-Nal-D-Cys-Pal-D-Trp-Lys-Thr-Cys-2R-(2-naphthyl)ethylamide; (H)(4-(2-hydroxyethyl)-1-piperizineethanesulfonyl)-beta-Nal-D-Cys-Pal-D-Trp-Lys-Thr-Cys-2R-(2-naphthyl)ethylamide; H2-Phe-D-Cys-Tyr-D-Trp-Lys-Val-Cys-2R-(2-naphthyl) ethylamide; (H)(CH3CO)Phe-D-Cys-Tyr-D-Trp-Lys-Val-Cys-2R-(2-naphthyl)ethylamide; (H)(4-(2-hydroxyethyl)-1-piperazinylacetyl)Phe-P-Cys-Tyr-D-Trp-Lys-Val-Cys-2R-(2-naphthyl)ethylamide; (H)(4-(2-hydroxyethyl)-1-piperazineethanesulfonyl)Phe-D-Cys-Tyr-D-Trp-Lys-Val-Cys-2R-(2-naphthyl)ethylamide; H2-Phe-D-Cys-Pal-D-Trp-Lys-Val-Cys-2R-(2-naphthyl)ethylamide; (H)(CH3CO)Phe-Cys-Pal-D-Trp-Lys-Val-Cys-2R-(2-naphthyl)ethylamide; (H)(4-(2-hydroxyethyl)-1-piperazinylacetyl)Phe-D-Cys-Pal-D-Trp-Lys-Val-Cys-2R-(2-naphthyl)ethylamide; (H)(4-(2-hydroxyethyl)-1-piperizineethanesulfonyl)Phe-D-Cys-Pal-D-Trp-Lys-Val-Cys-2R-(2-naphthyl)ethylamide; H2-Phe-D-Cys-Tyr-D-Trp-Lys-Thr-Cys-2R-(2-naphthyl) ethylamide; (H)(CH3CO)Phe-D-Cys-Tyr-D-Trp-Lys-Thr-Cys-2R-(2-naphthyl)ethylamide; (H)(4-(2-hydroxyethyl)-1-piperazinylacetyl)Phe-P-Cys-Tyr-D-Trp-Lys-Thr-Cys-2R-(2-naphthyl)ethylamide; (H)(4-(2-hydroxyethyl)-1-piperizineethanesulfonyl)Phe-D-Cys-Tyr-D-Trp-Lys-Thr-Cys-2R-(2naphthyl)ethylamide; H2-Phe-D-Cys-Pal-D-Trp-Lys-Thr-Cys-2R-(2-naphthyl)ethylamide; (H)(CH3CO)Phe-Cys-Pal-D-Trp-Lys-Thr-Cys-2R-(2-naphthyl)ethylamide; (H)(4-(2-hydroxyethyl)-1-piperazinylacetyl)Phe-P-Cys-Pal-D-Trp-Lys-Thr-Cys-2R-(2-naphthyl)ethylamide; (H)(4-(2-hydroxyethyl)-1-piperizineethanesulfonyl)Phe-D-Cys-Pal-D-Trp-Lys-Thr-Cys-2R-(2-naphthyl)ethylamide; H2-beta-Nal-D-Cys-Tyr-D-Trp-Lys-Abu-Cys-2R-(2-naphthyl) ethylamide; H2-Phe-D-Cys-Tyr-D-Trp-Lys-Abu-Cys-2R-(2-naphthyl)ethylamide; H2-beta-Nal-D-Cys-Tyr-D-Trp-Lys-Abu-Cys-2R,3R-(2-hydroxymethyl)-3-hydroxy) propyalmide; or H2-Phe-D-Cys-Tyr-D-Trp-Lys-Abu-Cys-2R,3R-(2-hydroxymethyl)-3-hydroxy)propylamide; H2-Phe-D-Phe-Tyr-D-Trp-Lys-Thr-Phe-Thr-NH2; H2-Phe-D-Phe-Tyr-D-Trp-Lys-Val-Phe-Thr-NH2; H2-Phe-D-Cpa-Tyr-D-Trp-Lys-Val-Phe-Thr-NH2; H2-beta-Nal-D-Cpa-Tyr-D-Trp-Lys-Val-Phe-Thr-NH2; (H)(CH3CO)-beta-Nal-D-Cpa-Tyr-D-Trp-Lys-Val-Phe-Thr-NH2; (H)(4-(2-hydroxyethyl)-1-piperazinylacetyl)-beta-Nal-D-Cpa-Tyr-D-Trp-Lys-Val-Phe-Thr-NH2; (H)(4-(2-hydroxyethyl)-1-piperizineethanesulfonyl)-beta-Nal-D-Cpa-Tyr-D-Trp-Lys-Val-Phe-Thr-NH2; H2-beta-Nal-D-Cpa-Pal-D-Trp-Lys-Val-Phe-Thr-NH2; (H)(CH3CO)-beta-Nal-D-Cpa-Pal-D-Trp-Lys-Val-Phe-Thr-NH2; (H)(4-(2-hydroxyethyl)-1-piperazinylacetyl)-beta-Nal-D-Cpa-Pal-D-Trp-Lys-Val-Phe-Thr-NH2; (H)(4-(2-hydroxyethyl)-1-piperizineethanesulfonyl)-beta-Nal-D-Cpa-Pal-D-Trp-Lys-Val-Phe-Thr-NH2; H2-beta-Nal-D-Cpa-Tyr-D-Trp-Lys-Thr-Phe-Thr-NH2; (H)(CH3CO)-beta-Nal-D-Cpa-Tyr-D-Trp-Lys-Thr-Phe-Thr-NH2; (H)(4-(2-hydroxyethyl)-1-piperazinylacetyl)-beta-Nal-D-Cpa-Tyr-D-Trp-Lys-Thr-Phe-Thr-NH2; (H)(4-(2-hydroxyethyl)-1-piperizineethanesulfonyl)-beta-Nal-D-Cpa-Tyr-D-Trp-Lys-Thr-Phe-Thr-NH2; H2-beta-Nal-D-Cpa-Pal-D-Trp-Lys-Thr-Phe-Thr-NH2; (H)(CH3CO)-beta-Nal-D-Cpa-Pal-D-Trp-Lys-Thr-Phe-Thr-NH2; (H)(4-(2-hydroxyethyl)-1-piperazinylacetyl)-beta-Nal-D-Cpa-Pal-D-Trp-Lys-Thr-Phe-Thr-NH2; (H)(4-(2-hydroxyethyl)-1-piperizineethanesulfonyl)-beta-Nal-D-Cpa-Pal-D-Trp-Lys-Thr-Phe-Thr-NH2; H2-beta-Nal-D-Cpa-Tyr-D-Trp-Lys-Val-Phe-beta-Nal-NH2; (H)(CH3CO)-beta-Nal-D-Cpa-Tyr-D-Trp-Lys-Val-Phe-beta-Nal-NH2; (H)(4-(2-hydroxyethyl)-1-piperazinylacetyl)-beta-Nal-D-Cpa-Tyr-D-Trp-Lys-Val-Phe-beta-Nal-NH2; (H)(4-(2-hydroxyethyl)-1-piperizineethanesulfonyl)-beta-Nal-D-Cpa-Tyr-D-Trp-Lys-Val-Phe-beta-Nal-NH2; H2-beta-Nal-D-Cpa-Tyr-D-Trp-Lys-Val-Phe-beta-Nal-NH2; or H2-beta-Nal-D-Cpa-Tyr-D-Trp-Lys-Val-Phe-Thr-NH2; H2-D-beta-Nal-D-Cpa-Phe-D-Trp-Lys-Val-Phe-Thr-NH2; H2-D-beta-Nal-D-Phe-Tyr-D-Trp-Lys-Thr-Phe-Thr-NH2; H2-D-Phe-D-Phe-Tyr-D-Trp-Lys-Val-Phe-Thr-NH2; H2-D-beta-Nal-D-Cpa-Tyr-D-Trp-Lys-Val-Phe-Thr-NH2; or H2-D-beta-Nal-D-Cpa-Tyr-D-Trp-Lys-Val-Phe-beta-Nal-NH2.

GHRH peptide analogues date back to the 1990s, and include the 'standard antagonist' [Ac-Tyr'. D-Arg2jhGH-RH (1-29) Nha. U.S. Pat. No. 4,659,893 (hereby incorporated in its entirety by reference thereto) discloses GH-RH antagonistic analogs which contain certain N,N'-dialkyl-omega-guanidino alpha-amino acyl residues in position 2 of the GH-RH (1-29) sequence. The following publications are of note, all of which are hereby incorporated by reference thereto. WO91/18923 describes hGH-RH modifications including: replacing Tyr1, Ala2, Asp3 or Asn8 with their D-isomers; replacing Asn8 with L- or D-Ser, D-Arg, Asn, Thr, Gln or D-Lys; replacing Ser9 with Ala to enhance amphiphilicity of the region; and replacing Goy'S with Ala or Aib. U.S. Pat. No. 5,084,555 describes an analogue [Se-psi [CH2-NH]-Tyr1°lhGH-RH (1-29) that includes a pseudopeptide bond (ie. a peptide bond reduced to a [CH2-RH] linkage) between the R9 and R10 residues. U.S. Pat. No. 5,550,212, U.S. Pat. No. 5,942,489, and U.S. Pat. No. 6,057,422 disclose analogs of hGH-RH (1-29) NH2 produced by replacement of various amino acids and acylation with aromatic or nonpolar acids at the N-terminus of GH-RH (1-29) NH2. The tumor inhibitory properties of antagonists featured in U.S. Pat. No. 5,942,489 and U.S. Pat. No. 6,057,422 have been demonstrated by using nude mice bearing xenografts of experimental human cancer models. Specific examples include: [PhAc-Tyr', D-Arg2, Phe (pCI) 6, Amp9, Tyr (Me010, Abu15, Nle27, D-Arg28, Har29] hGH-RH (1-29) NH2; [PhAc-Tyr', D-Arg2, Phe (pCI)6, Amp9, Abu15, Nle27, D-Arg28, Har29]hGH-RH(1-29)NH2; [PhAc-Tyr', D-Arg2, Phe (pCI) 6, His9, Tyr (Me)10, Abu15, Nle27, D-Arg28, Har29] hGH-RH (1-29) NH2; [CH3 (CH2) 6CO-Tyr1, D-Arg2, Phe (pCI)6, Amp9, Tyr (Me)10, Abu15, Nle27, D-Arg28, Har29]hGH-RH(1-29) NH2; [HOOC (CH2) 8CO-Tyr1, D-Arg2, Phe (pCI) 6, Amp9, Tyr (Me)10, Abu15, Nle27, D-Arg28, Har29]hGH-RH (1-29) NH2; [HOOC (CH2) 2CO-Tyr1, D-Arg2, Phe (pCI) 6, Amp9, Tyr (Me)10, Abu15, Nle27, D-Arg28, Har29]hGH-RH (1-29) NH2; [PhAc-Tyr', D-Arg2, Phe (pCI)6, Amp9, Tyr (Me)10, His11, Abu15, Nle27, D-Arg28, Har29]hGH-RH(1-29) NH2; [PhAc-Tyr', D-Arg2, Phe (pCI) 6, Cit8, Amp9, Tyr (Me)10, His", Abu'5, Nle27, D-Arg28, Har29] hGH-RH (1-29) NH2; [1-nac-Tyr1, D-Arg2, Phe (pCI) 6, Cit8, Amp9, Tyr (Me)10, His11, Abu15, Nle27, D-Arg28, Har29]hGH-RH (1-29) NH2; [CH3 (CH2) 6CO-Tyr', D-Arg2, Phe (pCI) 6, Cit8, Amp9, Tyr (Me)10, His", Abu15, Nle27, D-Arg28 Har'] hGH-RH (1-29) NH2; [HOOC (CH2) 12CO-Tyr', D-Arg2, Phe (pCI) 6, Cit8, Amp9, Tyr (Me)10, His", Abu'5, Nle27, D-Arg28, Har29] hGH-RH (1-29)NH2; [CH3 (CH2) 6CO-Tyr1, D-Arg2, Phe (pCI)6, Cit8, Amp9, Tyr $(Et)^{10}$, His", Abu'5, Nle27, D-Arg28, Har29] hGH-RH (1-29) NH2; [CH3 (CH2) 6CO-Tyr', D-Arg2, Phe (pCI) 6, Cit8, His9, Tyr (Et010, His11, Abu15, Nle27, D-Arg28, Har29]hGH-RH(1-29)NH2; [CH3 (CH2) 6CO-Tyr1, D-Arg2, Phe (pCI) 6, Alpe, His9, Tyr (Et)10, His11, Abu15, Nle27, D-Arg28, i Har29] hGH-RH (1-29) NH2; [HOOC (CH2) 8CO-Tyr1, D-Arg2, Phe(pCI)6, Ala8, His9, Tyr(Et)10, His11, Abu15, Nle27, D-Arg28, Har29] hGH-RH (1-29) NH2; [HOOC(CH2) 12CO-Tyr1, D-Arg2, Phe(pCI)6, Ala8, His9, Tyr(Et)10, His11, Abu15, Nle27, D-Arg28, Har29] hGH-RH (1-29)

NH2; [CH3 (CH2) 6CO-Tyr', D-Arg2, Phe (pCI)6, Ala8, His9, Tyr (Et)10, His11, Abu15, His20, Nle27, D-Arg28, Har29] hGH-RH (1-29) NH2; [CH3 (CH2) 6CO-Tyr1, D-Arg2, Phe (pCI)6, Ala8, Amp9, Tyr (Et)10, His11, Abu15, His20, Nle27, D-Arg28, Har29]hGH-RH(1-29)NH2; [HOOC (CH2)1 2CO-Tyr1, D-Arg2, Phe (pCI) 6, Ala8, His9, Tyr (Et)10, His11, Abu15, His20, Nle27, D-Arg28, Har2lhGH-RH' (1-29) NH2; [HOOC(CH2)12CO-Tyr1, D-Arg2; Phe(pCI)6, Ala8, Amp9, Tyr(Et)10, His11, Abu15, His20, Nle27, D-Arg28, Har29]hGH-RH(1-29)NH2; [1-Nac-Tyr1, D-Arg2, Phe (pCI) 6, Ala8, His9, Tyr (Et)10, His11, Abu15, Nle27, D-Arg28, Har29]hGH-RH(1-29) NH2; [CH3 (CH2) 6CO-Tyr1, D-Arg2, Phe (pCI) 6, His9, Tyr (Et)$^{10}$, His", Abu'5, Nle27, D-Arg28, Har29]hGH-RH (1-29) NH2; [CH3 (CH2) 6CO-Tyr', D-Arg2, Phe (pCI)6, Ala8, His9, Cit15, Nle27, D-Arg28, Har29]hGH-RH (1-29) NH2; [CH3 (CH2) 6CO-Tyr1, D-Arg2, Phe(pCI)6, Ala8, His9, tyr (Et)10, His11, His15, His20, Nle27, D-Arg28 Har29]hGH-RH (1-29) NH2; [CH3 (CH2) 6CO-Tyr', D-Arg2, Phe (pCI) 6, Ala8, His9, Tyr (Et)10, His11, Orn12, Abu15; Orn21, Nle27, D-Arg28, Har29] hGH-RH (1-29) NH2; [CH3 (CH2) 6CO-Tyr', D-Arg2, Phe (pCI) 6, Alas, His9, Tyr (Et)10, His11, Orn12, Abu15, His20, Orn21, Nle27, D-Arg28, Har29] hGH-RH (1-29) NH2; [CH3 (CH2) 6CO-Tyr1, D-Arg2, Phe (pCI)6, Ala8, His9, Tyr (Et)", His", Abu", Nle 2', D-Arg2, Har29]hGH-RH (1-29) NHEt; [CH3 (CH2) 8CO-Tyr1, D-Arg2, Phe (pCI) 6, Ala8, His9, Tyr (Et)10, His11, Abu15, Nle27, D-Arg28, Har29] hGH-RH (1-29) NHEt; [CH3 (CH2) 10CO-Tyr1, D-Arg2 Phe (pCI) 6 Ala8, His9, Tyr(Et)10, His11, Abu15, Nle27, D-Arg28 Har29] hGH-RH (1-29) NHEt; [Hca-Tyr1, D-Arg2, Phe(pCI)6, Ala8, His9, Tyr(Et)10, His11, Abu15, Nle27, D-Arg28, Har29]hGH-RH (1-29) NHEt; [CH3 (CH2) 6CO-Tyr', D-Arg2, Phe (pCI) 6, Ala8, His9, Tyr (Et)10, His11, Abu15, nle27, D-Arg28, Har29] hGH-RH (1-29)NHMe; [HOOC (CH2) 12CO-Tyr', D-Arg2, Phe (pCI) 6, Alas, His9, Tyr (Et)10, His11, Orn12, Abu15, His20, Orn21, Nle27 D-Arg28, Har29] hGH-RH (1-29) NH2; [CH3 (CH2) 6CO-Tyr', D-Arg2, Phe Cl)6, Ala8, Amp9, Tyr(Et)10, His11, Orn12, Abu15, His20, Orn21 Nle27, D-Arg28, Har29] hGH-RH (1-29) NH2; [CH3(CH2) 6CO-Tyr1, D-Arg2, Phe (pCI) 6, Ala8, His9, Dip10, His11, Orn12, Abu15, His20, Orn21, Nle27, D-Arg28, Har29]hGH-RH(1-29)NH2; [CH3 (CH2) 6CO-Tyr', D-Arg2, Phe (pCI) 6, Ala8, His9, Phe (pNO2)10, His11, Orn12, Abu15, His20, Orn21, Nle27, D-Arg28, Har29]hGH-RH(1-29)NH2; [CH3 (CH2)6CO-Tyr1, D-Arg2, Phe(pCI)6, Ala8, His9, Tyr(Et)10, His11, Orn12, Abu15, His20, Orn21, Nle27, D-Arg28, Har29] hGH-RH (1-29) NHEt; [HOOC 9CH2)12CO-Tyr1, D-Arg2, Phe (pCI) 6, Alas, Amp9, Tyr (Et)10, His", Orn, Abu15, His20, Orn21, Nle27, D-Arg28, Har29] hGH-RH (1-29) NH2; [HOOC (CH2) 2CO-Tyr1, D-Arg2 Phe (pCI) 6, Ala8, His9, Dip$^{10}$, His", Orn12, Abu'5, His, Orn21, Nle D-Arg28, Har29]hGH-RH (1-29) NH2; [HOOC(CH2) 12CO-Tyr1, D-Arg2, Phe (pCI) 6, Ala8, His9, Phe (pNO2)10, His11, Orn12, Abu15, His20, Orn21, Nle27, D-Arg28, Har29] hGH-RH (1-29) NH2; [HOOC (CH2) 12CO-Tyr-D-Arg2, Phe (pCI) 6, Alas, His9, Tyr (Et)10, His11, Orn12, Abu15, His20, Orn21, Nle27, D-Arg28, Har29] hGH-RH (1-29) NHEt; [CH3(CH2)6CO-Tyr1, D-Arg2, Phe (pCI) 6, Ala8, Amp9, Dip10, His11, Orn12, Abu15, His20, Orn21, Nle27, d-Arg28, Har29]hGH-RH (1-29) NH2; [CH3(CH2) 6CO-Tyr1, D-Arg2, Phe(pCI)6, Ala8, Amp9, Phe(pNO2)10, His11, Orn12, Abu15, His20, Orn21, Nle27, D-Arg28, Har29]hGH-RH(1-29)NH2; [CH3 (CH2) 6CO-Tyr1, D-Arg2, Phe(pCI)6, Ala8, Amp9, Tyr(Et)10, His11, Orn12, Abu15, His20, Orn21, Nle27, D-Arg28, Har29]hGH-RH(1-29) NHEt; [CH3 (CH2) 6CO-Tyr1, D-Arg2, Phe (pCI) 6, Ala8, His9, Dip10, His11, Orn12, Abu15, His20, Orn21, Nle27, D-Arg28, Har29]hGH-RH (1-29) NHEt: [CH3 (CH2) 6CO-Tyr1, D-Arg2, Phe (pCI) 6, Ala8, His9, Phe (pN02)$^{10}$, His", Orn'2, Abu'5, His20, Orn21, Nle27, D-Arg28, Har29] hGH-RH (1-29) NHEt; [HOOC (CH2) 12CO-Tyr', D-Arg2, Phe (pCI)6, Ala8, Amp9, Dip10, His", Orn12, Abu15, His20, Orn21, Nle27 D-Arg Har29] hGH-RH (1-29) NH2; [HOOC (CH2)12CO-Tyr1, D-Arg2, Phe (pCI) 6, Ala8, Amp9, Phe (pN02) 10, His11, Orn12, Abu15, His20, Orn21, Nle27, D-Arg28, Har29] hGH-RH (1-29) NH2; [CH3 (CH2) 6CO-Tyr1, D-Arg2, Phe (pCI) 6, Ala', Amp9 Dip$^{10}$, His", Orn12, Abu15, His20, Orn21, Nle27, D-Arg28, Har29]hGH-RH (1-29) NHEt; [CH3 (CH2) 6CO-Tyr', D-Arg2; Phe (pCI) 6, Ala8, Amp9, Phe (pNO2)10, His11, orn12, Abu15, His20, Orn21, Nle27, D-Arg28, Har29] hGH-RH (1-29) NHEt; [HOOC (CH2) 12CO-Tyr1, D-Arg2, Phe (pCI) 6, Ala8, Amp9, Dip10, His11, Orn12, Abu15, his20, Orn21, Nle27, D-Arg28, Har29] hGH-RH (1-29) NHEt; [HOOC (CH2)1 2CO-Tyr1, D-Arg2, Phe (pCI) 6, Alas, Amp9, Phe (pNO2)10, His", Orn12, Abu15, His20 Orn21, Nle27, D-Arg28, Har29] hGH-RH (1-29) NHEt; [CH3 (CH2) 4CO-Tyr1, D-Arg2, Phe (pCI)6, Arg9, Abu15, Nle27, D-Arg28, Har29]hGH-RH(1-29)NH2; [HOOC (CH2) 4CO-Tyr', D-Arg2, Phe (pCI)6, Arg9, Abu15, Nle27, D-Arg28, Har29] hGH-RH (1-29) NH2; [CH3 (CH2) 6CO-Tyr1, D-Arg2, Phe (pCI) 6, Arg9, Abu15, Nle27, D-Arg28, Har29]hGH-RH (1-29) NH2; [HOOC (CH2)6CO-Tyr1, D-Arg2, Phe(pCI)6, Arg9, Abu15, Nle27, D-Arg28, Har29]hGH-RH(1-29)NH2; [CH3(CH2)8CO-Tyr1, D-Arg2, Phe (pCI) 6, Arg9, Abu'5, Nle27, D-Arg28, Har29] hGH-RH (1-29) NH2; [HOOC(CH2)8CO-Tyr1, D-Arg2, Phe(pCI)6, Arg9, Abu15, Nle27, D-Arg28, Har29] hGH-RH(1-29)NH2; [CH3 (CH2)1 0CO-Tyr1, D-Arg2 Phe Cl)6, Arg9, Abu15, Nle27, D-Arg26, Har29]hGH-RH(1-29) NH2; [HOOC (CH2) 0CO-Tyr1, D-Arg2, Phe (pCI)6, Arg9, Abu15, Nle27, D-Arg28, Har29]hGH-RH(1-29)NH2; [CH3 (CH2) 12CO-Tyr', D-Arg2, Phe (pCI)6, Arg9, Abu15, Nle27, D-Arg28, Har29]hGH-RH (1-29) NH2; [HOOC (CH2) i2CO-Tyr\ D-Arg2, Phe (pCI)6, Arg9, Abu15, Nle27, D-Arg28, Har29]hGH-RH (1-29) NH2; [CH3 (CH2) 4CO-Tyr1 D-Arg2, Phe (pCI) 6, Arg9, Abu15, Nle27, D-Arg28, Har29]hGH-RH (1-29) NH2; [HOOC (CH2) 4CO-Tyr1, D-Arg2, Phe (pCI)6, Arg9, Abu15, Nle27, D-Arg28, Har29] hGH-RH (1-29) NH2; [CH3 (CH2) CO-Tyr1, D-Arg2, Phe (pCI)6, Arg9, Abu15, Nle27, Har28, D-Arg29]hGH-RH(1-29)NH2; [PhAc-Tyr', D-Arg2, Phe (pCI) 6, Arg9, Abu'5, Nle27, Har28, D-Arg29] hGH-RH (1-29) NH2; [CH3 (CH2) 4CO-Phe0, D-Arg2, Phe (pCI) 6, Arg9, Abu15, Nle27, D-Arg28, har29] hGH-RH (1-29) NH2; [CH3 (CH2) 14CO-D-Phe0, D-Arg2, Phe (pCI)6, Arg9, Abu15, Nle27, D-Arg28, Har29]hGH-RH (1-29) NH2; [PhAc-Arg°, D-Arg2, Phe (pCI) 6, Arg9, Abu'5, NLe27, D-Arg28, Har29] hGH-RH (1-29) NH2; [PhAc-D-Arg°, D-Arg2, Phe (pCI) 6, Arg9, Abu'5, Nle27, D-Arg28, Har29] hGH-RH (1-29) NH2; [PhAc-Tyrl, D-Arg2, Phe (pCI) 6, Cite, Arg9 Abut5 Nle27, D-Arg28, Har29] hGH-RH (1-29) NH2; [PhAc-Tyr', D-Arg2, Phe (pCI) 6, Cite, Cit9, Abu15, Nle27, D-Arg28; har29]hGH-RH(1-29)NH2; [PhAc-Tyr', D-Arg2, Phe (pCI) 6, Cit8, Arg9, Abu'5, Nle27, Har28, D-Arg29]hGH-RH (1-29) NH2; [PhAc-Tyr1, D-Arg2, Phe (pCI)6, Cit8, Cit9, Abu15, Nle27, Har28, D-Arg29]hGH-RH (1-29) NH2; [HOOC (CH2) i2CO-Tyr\ D-Arg2, Phe (pCI)6, Cit8, Cit9, Abu15, Nle27, D-Arg28, Har29]hGH-RH(1-29) NH2; [PhAc-Tyr1, D-Arg2, Phe (pCI) 6, D-Ala8, Arg9, Abu15, Nle27, D-Arg28, Har29] hGH-RH (1-29) NH2; [PhAc-Tyr1, D-Arg2, Phe (pCI) r3, Abu3, Arg9, Abu'5, Nle27, D-Arg28, Har29] hGH-RH (1-29) NH2; [PhAc-Tyr', D-Arg2, Phe (pCI)6, Cit9, Abu15, Nle27, Har28, D-Arg29]hGH-RH (1-29) NH2; [PhAc-Tyr', D-Arg2, Phe (pCI) 6, Arg9, Amp[10], Abu'5, Nle27, D-Arg28; Har29] hGH-RH (1-29) NH2; [PhAc-Tyr1, D-Arg2, Phe (pCI) 6, Har9, Amp10 Abu5, Nle27, D-Arg28, Har29 hGH-RH (1-29) NH2; PhAc-Tyr1, D-Arg2, Phe (pCI) 6 Arg9, His'o, Abu'5, Nle 27, D-Arg28, Ha) hGH-RH (1-29) NH2; [PhAc-Tyr', D-Arg2, Phe (pCI) 6, Arg9, Cha10, Abu15, Nle27, D-Arg28, Har29]hGH-RH(1-29)NH2; [PhAc-Tyr', D-Arg2, Phe (pCI) 6, Har9, Tpl10, Abu15, Nle27, D-Arg28, har29]hGH-RH (1-29) NH2; PhAc-Tyr1, D-Arg2, Phe(pCI)6, Har9, 2-Nal10, Abu15, Nle27, D-Arg28, Har29]hGH-RH(1-29)NH2; [PhAc-Tyr1, D-Arg2, Phe (pCI) 6, Har9, Dip10, Abu15, Nle27, D-Arg28, Har29]hGH-RH (1-29) NH2; [PhAc-Tyr1, D-Arg2, Phe(pCI)6, Har9, Phe (pNH2)10, Abu15, Nle27, D-Arg28; Har29]hGH-RH (1-29) NH2; [PhAc-Tyr1, D-Arg2 Phe (pCI) zu Har9, Trpt°, Abu15 Nle27, D-Arg28, Har29] hGH-RH(1-29)NH2; [PhAc-Tyr1, D-Arg2, Phe(pCI)6, Har9, Phe(pNO2)10, Abu15, Nle27, D-Arg28, Har29]hGH-RH(1-29)NH2; [PhAc-Tyr1, D-Arg2, Phe (pCI)6, Har9, 3-Pal10, Abu15, Nle27, D-Arg28, Har29] hGH-RH (1-29) NH2; [PhAc-Tyrl, D-Arg2, Phe (pCI) 6, Har9, Tyr (Et)[10], Abu15, Nle27, D-Arg28, Har29] hGH-RH (1-29) NH2: [PhAc-His', D-Arg2, Tyr6, Har9, Bpa10, Abu'5, Nle27, D-Arg28, Har29] hGH-RH (1-29) NH2; [PhAc-Tyr', D-Arg2; Phe (pCI) 6, Arg9, Har12, Abu15, Nle27, D-Arg28, Har29] hGH-RH (1-29) NH2; [Hca-Tyr', D-Arg2, Phe (pCI) 6, Har9, Tyr (Me) 10, Abu15, Nle27, D-Arg28, Har29]hGH-RH (1-29) NHEt; [PhAc-Tyr'D-Arg2, Phe (pCI) 6 Har9, Tyr(Me)10, Abu15, Nle27, D-Arg28, Har29] hGH-RH (1-29) NHEt; [Hca-Tyr1, D-Arg2, Phe (pCI)6, Arg9, Abu15, Nle27, D-Arg28, Har29 [hGH-RH(1-29) NHEt; PhAc-Tyr1, D-Arg2 Phe Cl)6, Arg9, Abu15, Nle27, D-Arg28, Har29]hGH-RH(1-29 NHEt; [PhAc-Tyr1, D-Arg2, Phe (pCI) 6, Har9, Tyr (Me)10, Aib15, Nle27, D-Arg28, Har29] hGH-RH (1-29) NHEt; [PhAc-Tyr', D-Arg2, Phe (pCI) 6, Har9, Tyr (Me)10, Orn12, Abu15, Nle27, D-Arg28, Har29] hGH-RH (1-29) NHEt; [Hca-Tyr1, D-Arg2, Phe (pCI) 6, Har9, Tyr (Me)10, Abu15, Nle27, D-Arg28, Agm29]hGH-RH (1-29); [PhAc-Tyr1, D-Arg2, Phe (pCI) 6, Har9, Tyr (Me)[10], Abu15, Nle27, D-Arg28, Agm29]hGH-RH(1-29); [Hca-Tyr1, D-Arg2, Phe (pCI) 6, Har9, Tyr (Me)10, Abu 15, Nle27, D-Arg28, Har29, Har30] hGH-RH(1-30) NH2; [Dat-Tyr1, D-Arg2, Phe (pCI)6, Har9, Tyr (Me)10, Abu15, Nle27, D-Arg28, Har29, Har30]hGH-RH (1-30) NH2; [Ipa-Tyr1, D-Arg2, Phe (pCI) 6, Har9, Tyr (Me)10, Abu15, Nle27, D-Arg28, Har29, Har30]hGH-RH(1-30)NH2; [Hca-Tyr', D-Arg2, Phe (pCI) 6, Har9, Tyr (Me)10, Abu15, Nle27, D-Arg28, Har29, Har30] hGH-RH (1-30) NHEt; [Hca-Tyr', D-Arg2, Phe (pCI) 6, Har9, Tyr (Me10), Abu15, Nle27, D-Arg28, D-Arg29, Har30]hGH-RH(1-30) NH2; [Hca-Tyr'; D-Arg2, Phe (pCI) 6, Har9, Tyr (Me)10, Abu15, Nle27, D-Arg28, Har29, D-Arg30]hGH-RH(1-30) NH2; [Hca-Tyr', D-Arg2, Phe (pCI) 6, Har9, Tyr (Me)10, Abu15, Nle27, D-Arg28, Har29, Agm30] hGH-RH (1-30); [PhAc-Tyr', D-Arg2, Phe (pCI) 6, Har9, Tyr (Me)10, Abu15, Nle27, D-Arg28, Har29, Agm30] hGH-RH (1-30); [PhAc-Tyr', D-Arg2, Phe (pCI) 6, Har9, Tyr (Me)10, His11, Abu15, Nle27, D-Arg28, Har29]hGH-RH(1-29)NH2; [PhAc-Tyr1, D-Arg2, Phe(pCI)6, Har9, Tyr(Me)10, Har11, Abu15, Nle27, D-Arg28, Har29]hGH-RH(1-29) NH2

[PhAc-Tyr1, D-Arg2, Phe(pCI)6, Har9, Tyr (Me)10, Amp11, Abu15, Nle27, D-Arg28, Har29] hGH-RH (1-29) NH2; [PhAc-Tyr1, D-Arg2, Phe (pCI)6, Har9, Tyr (Me)10, Cit", Abu15, Nle27, D-Arg28, Har29]hGH-RH(1-29) NH2; [PhAc-Tyr1, D-Arg2, Phe (pCI)6, Har9, Tyr (Me)[10], Abu15, His20, Nle, D-Arg28, Har29]hGH-RH(1-29) NH2; [PhAc-Tyr', D-Arg2, Phe(pCI)6, Har9, Tyr (Me)10, His", Abu15, His20, Nle27, D-Arg28, Har29]hGH-RH (1-29) NH2; [PhAc-Tyr1, D-Arg2, Phe (pCI) 6, Arg9; Cit15, Nle27, D-Arg28, Har29]hGH-RH(1-29)NH2; [PhAc°, D-Arg2, Phe (pCI)6, Arg9, Abu15, Nle27, D-Arg28, Har29] hGH-RH (1-29) NH2; [IndAc0, D-Arg2, Phe(pCI)6, Arg9, Abu15, Nle27, D-Arg28, Har29]hGH-RH(1-29) NH2; [PhAc°, D-Arg2, Phe pCI) r, Har9, Tyr(Me)10, Abu15, Nle27, D-Arg28, Har29]hGH-RH (1-29) NH2; [PhAc°, D-Arg2, Phe(pCI)6, Arg9, Tyr(Me)10, Abu15, Nle27, D-Arg28, Har29] hGH-RH (1-29) NH2; [PhAc°, His', D-Arg2, Phe (pCI)6, Arg9, Abu15, Nle27, D-Arg28, Har29]hGH-RH(1-29) NH2; [Nac°, His', D-Arg2, Phe (pCI) 6, Arg9, Abu15, Nle27, D-Arg28, Har29] hGH-RH (1-29) NH2; [PhAc°, D-Arg2, Phe (pCI) 6 Arg9, Abu'5, Nle27, D-Arg28, Har29] hGH-RH (1-29) NH2; [IndAc°, D-Arg2, Phe (pCI)6, Arg9, Abu15, Nle27, D-Arg28, Har29] hGH-RH (1-29) NH2; [PhAc°, D-Arg2, Phe (pCI) 6, Har9, Tyr (Me)10, Abu15, Nle27, D-Arg28, Har29] hGH-RH (1-29) NH2; [PhAc°, D-Arg2, Phe (pCI) 6, Arg9, Tyr (Me)10, Abu15, Nle27, D-Arg28, Har29] hGH-RH (1-29) NH2; [PhAc°, His', D-Arg2, Phe (pCI)6, Arg9, Abu15, Nle27, D-Arg28, Har29] hGH-RH(1-29)NH2; [Nac°, His', D-Arg2, Phe(pCI)6, Arg9, Abu15, Nle27, D-Arg28, Har29] hGH-RH (1-29) NH2; [PhAc°, D-$Arg^2$, $Phe(pCI)^{11}$, $Ala^{15}$, $Nle^{27}$, $Asp^{28}$]hGH-RH (1-28)Agm; [Ibu°,D-$Arg^2$, $Phe(pCI)^{8\ 10}$, $Abu^{15}$, $Nle^{27}$]hGH-RH(1-28)Agm; [PhAc°,D-$Arg^2$, $Phe(pCI)^6$, $Abu^{15}$, $Nle^7$] hGH-RH(1-28)Agm; [PhAc°,D-$Arg^2$, $Phe(pCI)^6$, $Ala^{15}$, $Nle^{27}$]hGH-RH(1-29)-$NH_2$; [PhAc°, D-$Arg^2$,$Phe(pCI)^6$, $Abu^8$,$Ala^{15}$,$Nle^{27}$]hGH-RH(1-29)$NH_2$; [$PhAc^0$, D-$Arg^2$, $Phe(pCI)^6$, $Abu^{8,28}$, $Ala^{15}$, $Nle^{27}$]hGH-RH(1-29)-$NH_2$; $cyclo^{8,12}$[PhAc°, D-$Arg^2$,$Phe(pCI)^6$,$Glu^{\beta}$,$Ala^{15}$, $Nle^{27}$] hGH-RH(1-29)-$NH_2$; $cyclo^{17,21}$ [PhAc°,D-$Arg^2$,$Phe(pCI)^6$, $Ser^8$,$Ala^{15}$,$Glu^{17}$,$Nle^{27}$]hGH-RH(1-29)-$NH_2$; $cyclo^{8,12;21,25}$ [PhAc°,D-$Arg^2$$Phe(pCI)^8$,$Glu^{8,25}$,$Abu^{15}$,$Nle^{27}$]hGH-RH(1-28)Agm; $cyclo^{8,12;21,25}$[PhAc°,D-$Arg^2$,D-$Asp^3$,$Phe(pCI)^8$, $Glu^{8,25}$,D-$Lys^{12}$,$Ala^{16}$,$Nle^{27}$]hGH-RH(2-29)-$NH_2$; $cyclo^{8,12;21,25}$[[PhAc°,D-$Arg^2$,$Phe(pCI)^6$, $Glu^{8,25}$, D-$Lys^{12}$, $Ala^{15}$, $Nle^{27}$] hGH-RH(1-29)-$NH_2$. Additional GHRH analogue examples are provided in WO96/032126, WO96/022782, WO96/016707, WO94/011397, WO94/011396, each of which is herein incorporated by reference thereto.

Examples of bombesin analogues suitable for use in the present invention include TMs comprising: D-Phe-Gln-Trp-Ala-Val-Gly-His-Leu-Met-$NH_2$ (code named BIM-28218), D-Phe-Gln-Trp-Ala-Val-Gly-His-Leu-Leu-$NH_2$ (code named BIM-26187); D-Cpa-Gln-Trp-Ala-Val-Gly-His-Leu-Φ [$CH_2NH$]-Phe-$NH_2$ (code named BIM-26159), and D-Phe-Gln-Trp-Ala-Val-Gly-His-Leu-Φ [$CH_2NH$]-Cpa-$NH_2$ (code named BIM-26189); D-Phe-Gln-Trp-Ala-Val-N-methyl-D-Ala-His-Leu-methylester, and D-$F_g$-Phe-Gln-Trp-Ala-Val-D-Ala-His-Leu-methylester.

Bombesin analogues include peptides derived from the naturally-occurring, structurally-related peptides, namely, bombesin, neuromedin B, neuromedin C, litorin, and GRP. The relevant amino acid sequences of these naturally occurring peptides are: Bombesin (last 10 amino acids): Gly-Asn-Gln-Trp-Ala-Val-Gly-His-Leu-Met-$NH_2$; Neuromedin B: Gly-Asn-Leu-Trp-Ala-Thr-Gly-His-Phe-Met-$NH_2$; Neuromedin C: Gly-Asn-His-Trp-Ala-Val-Gly-His-Leu-Met-$NH_2$; Litorin: pGlu-Gln-Trp-Ala-Val-Gly-His-Phe-Met-$NH_2$; Human GRP (last 10 amino acids): Gly-Asn-His-Trp-Ala-Val-Gly-His-Leu-Met-$NH_2$.

Analogs suitable for use in the present invention include those described in U.S. Ser. No. 502,438, filed Mar. 30, 1990, U.S. Ser. No. 397,169, filed Aug. 21, 1989, U.S. Ser. No. 378,555, filed Jul. 7, 1989, U.S. Ser. No. 394,727, filed Aug. 16, 1989, U.S. Ser. No. 317,941, filed Mar. 2, 1989, U.S. Ser. No. 282,328, filed Dec. 9, 1988, U.S. Ser. No. 257,998, filed Oct. 14, 1988, U.S. Ser. No. 248,771, filed Sep. 23, 1988, U.S.

Ser. No. 207,759, filed Jun. 16, 1988, U.S. Ser. No. 204,171, filed Jun. 8, 1988, U.S. Ser. No. 173,311, filed Mar. 25, 1988, U.S. Ser. No. 100,571, filed Sep. 24, 1987; and U.S. Ser. No. 520,225, filed May 9, 1990, U.S. Ser. No. 440,039, filed Nov. 21, 1989. All these applications are hereby incorporated by reference. Bombesin analogs are also described in Zachary et al., Proc. Nat. Aca. Sci. 82:7616 (1985); Heimbrook et al., "Synthetic Peptides: Approaches to Biological Problems", UCLA Symposium on Mol. and Cell. Biol. New Series, Vol. 86, ed. Tarn and Kaiser; Heinz-Erian et al., Am. J. Physiol. G439 (1988); Martinez et al., J. Med. Chem. 28:1874 (1985); Gargosky et al., Biochem. J. 247:427 (1987); Dubreuil et al., Drug Design and Delivery, Vol 2:49, Harwood Academic Publishers, GB (1987); Heikkila et al., J. Biol. Chem. 262: 16456 (1987): Caranikas et al., J. Med. Chem. 25:1313 (1982): Saeed et al., Peptides 10:597 (1989): Rosell et al., Trends in Pharmacological Sciences 3:211 (1982); Lundberg et al., Proc. Nat. Aca. Sci. 80:1120, (1983): Engberg et al., Nature 293:222 (1984); Mizrahi et al., Euro. J. Pharma. 82:101 (1982); Leander et al., Nature 294:467 (1981); Woll et al., Biochem. Biophys. Res. Comm. 155:359 (1988); Rivier et al., Biochem. 17:1766 (1978); Cuttitta et al., Cancer Surveys 4:707 (1985); Aumelas et al., Int. J. Peptide Res. 30:598 (1987); all of which are also hereby incorporated by reference.

The analogs can be prepared by conventional techniques, such as those described in WO92/20363 and EP0737891.

Additional bombesin analogues suitable for use in the present invention comprise: D-Phe-Gln-Trp-Ala-Val-Gly-His-Leu-jjsi-Tac-NH2; D-Tpi-Gln-Trp-Ala-Val-Gly-His-Leu-ξsi-Tac-$NH_2$; D-Phe-Gln-Trp-Ala-Val-Gly-His-Leu-ξsi-DMTac-NH2; Hca-Gln-Trp-Ala-Val-Gly-His-Leu-jβsi-Tac-$NH_2$; D-Trp-Gln-Trp-Ala-Val-Gly-His-Leu-psi-Leu-$NH_2$; D-Trp-Gln-Trp-Ala-Val-Gly-His-Leu-psi-Phe-$NH_2$; D-Trp-Glu(MeNH)-Trp-Ala-Val-Gly-His-Leu-psi-Phe-$NH_2$; D-Trp-Gln-Trp-Ala-Val-Gly-His-Leu-psi-Trp-$NH_2$; D-Tpi-Gln-Trp-Ala-Val-Gly-His-Leu-psi-Leu-$NH_2$; D-Tpi-Gln-Trp-Ala-Val-Gly-His-Leu-psi-Phe-$NH_2$; D-Tpi-Gln-Trp-Ala-Val-Gly-His-Leu-psi-Trp-$NH_2$; D-pGlu-Gln-Trp-Ala-Val-Gly-His-Leu-psi-Tpi-$NH_2$; D-Phe-Gln-Trp-Ala-Val-Gly-His-Leu-psi-Tpi-$NH_2$; D-Trp-Gln-Trp-Ala-Val-Gly-His-Leu-psi-Tpi-$NH_2$; Tpi-Gln-Trp-Ala-Val-Gly-His-Leu-psi-Tpi-NH2; $NH_2$CO-Tpi-Gln-Trp-Ala-Val-Gly-His-Leu-psi-Tpi-$NH_2$ and ACY-Tpi-Gln-Trp-Ala-Val-Gly-His-Leu-psi-Tpi-$NH_2$wherein ACY is acetyl, octanoyl or 3-hydroxy-2-naphthoyl; D-Tpi-Gln-Trp-Ala-Val-Gly His-Leu-psi-Tpi-$NH_2$; D-Trp-Glu(MeO)-Trp-Ala-Val-Gly-His-Leu-psi-Tpi-$NH_2$; D-Trp-Glu(MeNH)-Trp-Ala-Val-Gly-His-Leu-psi-Tpi-$NH_2$; D-Trp-His(Bz)-Trp-Ala-Val Gly-His-Leu-psi-Tpi-$NH_2$; Phe-Glu-Trp-Ala-Val-Gly His-Leu-psi-Tpi-$NH_2$; $H_2$-D-Nal-Cys-Tyr-D-Trp-Lys-Val-Cys-Nal-$NH_2$; $H_2$-D-Nal-Cys-Tyr-D-Trp-Lys-Nal-Cys-Thr-$NH_2$; $H_2$-D-Nal-Cys-Tyr-D-Trp-Lys-Nal-Cys-Nal-$NH_2$; $H_2$-D-Phe-Cys-Tyr-D-Trp-Lys-Val-Cys-Nal-$NH_2$; $H_2$-D-Nal-Cys-Tyr-D-Trp-Lys-Val-Cys-D-Nal-$NH_2$; $H_2$-Nal-Cys-Tyr-D-Trp-Lys-Val-Cys-D-Nal-$NH_2$; $H_2$-D-Nal-D-Cys-Tyr-D-Trp-Lys-Val-Cys-Nal-$NH_2$; $H_2$-D-Nal-Cys-Tyr-D-Trp-Lys-Val-D-Cys-Nal-$NH_2$; $H_2$-D-Trp-Cys-Tyr-D-Trp-Lys-Val-Cys-Nal-$NH_2$; $H_2$-D-Nal-Cys-Tyr-D-Trp-Lys-Phe-Cys-Nal-$NH_2$; $H_2$-D-Nal-Cys-Tyr-D-Nal-Lys-Val-Cys-Nal-$NH_2$; $H_2$-D-Phe-Cys-Tyr-D-Trp-Lys-Nal-Cys-Thr-$NH_2$; $H_2$-D-Nal-Cys-Tyr-D-Trp-Orn-Val-Cys-Nal-$NH_2$; $H_2$-D-Phe-Cys-Tyr-D-Trp-Lys-Thr-Cys-Nal-$NH_2$; $H_2$-D-Phe-Cys-Tyr-D-Trp-Lys(iPr)-Thr-Cys-Nal-$NH_2$; $H_2$-D-Phe-Cys-Tyr-D-Trp-Lys(diEt)-Thr-Cys-Nal-$NH_2$ $H_2$-D-Phe-Cys-Tyr-D-Trp-Lys-Ser-Cys-Thr-$NH_2$; $H_2$-D-Nal-Cys-Tyr-D-Trp-Lys-Thr-Cys-Nal-$NH_2$; $H_2$-D-Nal-D-Cys-Tyr-D-Trp-Lys-Thr-Cys-Nal-$NH_2$; or $H_2$-D-Nal-Cys-Phe-D-Trp-Lys-Thr-Cys-Nal-$NH_2$; $H_2$-D-Nal-Cys-Tyr-D-Trp-Dab-Val-Cys-Nal-$NH_2$, $H_2$-D-Nal-Cys-Tyr-D-Trp-Orn-Val-Cys-Nal-$NH_2$, $H_2$-D-Nal-Cys-Tyr-D-Trp-Arg-Val-Cys-Nal-$NH_2$; pGlu-Gln-Trp-Ala-Val-Gly-His-Leu-Leu-$NH_2$, D-Phe-Gln-Trp-Ala-Val-Gly-His-Leu-Leu-$NH_2$, D-Phe-Gln-Trp-Ala-Val-Gly-His-Leu-Met-$NH_2$, D-Cpa-Gln-Trp-Ala-Val-Gly-His-Leu-Met-$NH_2$, D-Cpa-Gln-Trp-Ala-Val-Gly-His-Leu-Leu-$NH_2$, D-Phe-Gln-Trp-Ala-Val-D-Ala-His-Leu-Leu-$NH_2$, D-Phe-Gln-Trp-Ala-Val-D-Ala-His-Leu-Met-$NH_2$, D-Cpa-Gln-Trp-Ala-Val-D-Ala-His-Leu-Met-$NH_2$, pGlu-Gln-Trp-Ala-Val-Gly-His-Phe-Leu-$NH_2$, D-Phe-Gln-Trp-Ala-Val-Gly-His-Phe-Leu-$NH_2$, D-Phe-Gln-Trp-Ala-Val-D-Ala-His-Phe-Met-$NH_2$, D-Phe-Gln-Trp-Ala-Val-D-Ala-His-Phe-Leu-$NH_2$, D-Phe-Gln-Trp-Ala-Val-Gly-His-Leu-Nle-$NH_2$, D-Phe-Gln-Trp-Ala-Val-D-Ala-His-Leu-Nle-$NH_2$, D-Phe-Gln-Trp-Ala-Val-Gly-His-Phe-Nle-$NH_2$, D-Phe-Gln-Trp-Ala-Val-D-Ala-His-Phe-Nle-$NH_2$, D-p-Cl-Phe-Gln-Trp-Ala-Val-Gly-His-Leuc[$CH_2$NH]Phe-$NH_2$, D-Phe-Gln-Trp-Ala-Val-Gly-His-Leu-proplyamide, Ac-His-Trp-Ala-Val-D-Ala-His-Leu-Leu-$NH_2$, D-Phe-Gln-Trp-Ala-Val-Gly-His-CHx-Ala-Leu-$NH_2$, cyclo-D-Phe-Gln-Trp-Ala-Val-Gly-His-Leu-Leu, D-Cys-Asn-Trp-Ala-Val-Gly-His-Leu-Cys-$NH_2$, cyclo-His-Trp-Ala-Val-Gly-His-Leu-Met, Cys-Trp-Ala-Val-Gly-His-Leu-Cys-$NH_2$, cyclo-D-Phe-Gln-Trp-Ala-Val-Gly-His-Leu-Met, cyclo-D-Phe-His-Trp-Ala-Val-Gly-His-Leu-Met, cyclo-Trp-Ala-Val-Gly-His-Leu-Met.

Additional bombesin analogues are described in, for example, WO89/02897, WO91/17181, WO90/03980 and WO91/02746, all of which are herein incorporated by reference thereto.

Examples of ghrelin analogues suitable for use as a TM of the present invention comprise: Tyr-DTrp-DLys-Trp-DPhe-$NH_2$, Tyr-DTrp-Lys-Trp-DPhe-$NH_2$, His-DTrp-DLys-Trp-DPhe-$NH_2$, His-DTrp-DLys-Phe-DTrp-$NH_2$, His-DTrp-DArg-Trp-DPhe-$NH_2$, His-DTrp-DLys-Trp-DPhe-Lys-$NH_2$, DesaminoTyr-DTrp-Ala-Trp-DPhe-$NH_2$, DesaminoTyr-DTrp-DLys-Trp-DPhe-$NH_2$, DeaminoTyr-DTrp-Ser-Trp-DPhe-Lys-$NH_2$; DesaminoTyr-DTrp-Ser-Trp-DPhe-$NH_2$, His-DTrp-DTrp-Phe-Met-$NH_2$, Tyr-DTrp-DTrp-Phe-Phe-$NH_2$, Glyψ[$CH_2$NH]-DβNal-Ala-Trp-DPhe-Lys-$NH_2$, Glyψ[CH2NH]-DbetaNal-DLyS-TrP-DPhe-Lys-$NH_2$, DAla-DbetaNal-DLys-DTrp-Phe-Lys-$NH_2$, His-DbetaNal-DLys-Trp-DPhe-Lys-$NH_2$, Ala-His-DTrp-DLys-Trp-DPhe-Lys-$NH_2$, Alaφ[$CH_2$NH]-DbetaNal-Ala-Trp-DPhe-Lys-$NH_2$, DbetaNal-Ala-Trp-DPhe-Ala-$NH_2$, DAla-DcyclohexylAla-Ala-Phe-DPhe-Nle-$NH_2$, DcyclohexylAla-Ala-Phe-DTrp-Lys-$NH_2$, DAla-DbetaAla-Thr-DThr-Lys-$NH_2$, DcyclohexylAla-Ala-Trp-DPhe-NH2, DAla-DbetaNal-Ala-Ala-DAla-Lys-$NH_2$, DbetaNal-Ala-Trp-DPhe-Leu-$NH_2$, His-DTrp-Phe-Trp-DPhe-Lys-$NH_2$, DAla-DbetaNal-DAla-DTrp-Phe-Lys-$NH_2$, pAla-Trp-DAla-DTrp-Phe-$NH_2$, His-Trp-DAla-DTrp-Phe-Lys$NH_2$, DLys-DβNal-Ala-Trp-DPhe-Lys-$NH_2$, DAla-DbetaNal-DLys-DTrp-Phe-Lys-$NH_2$, Tyr-DAla-Phe-Alb-$NH_2$, Tyr-DAla-Sar-NMePhe-$NH_2$, αγAbu-DTrp-DTrp-Ser-$NH_2$, αγAbu-DTrp-DTrp-Lys-$NH_2$, αγAbu-DTrp-DTrp-Orn-$NH_2$, αAbu-DTrp-DTrp-Orn-$NH_2$, DThr-DαNal-DTrp-DPro-Arg-$NH_2$, DAla-Ala-DAla-DTrp-Phe-Lys-$NH_2$, Alaψ[$CH_2$NH]His-DTrp-Ala-Trp-DPhe-Lys-$NH_2$, Lys-DHis-DTrp-Phe-$NH_2$, γAbu-DTrp-DTrp-Orn-$NH_2$, inip-Trp-Trp-Phe-$NH_2$, Ac-DTrp-Phe-DTrp-Leu-$NH_2$, Ac-DTrp-Phe-DTrp-Lys-$NH_2$, Ac-DTrp-DTrp-Lys-$NH_2$, DLys-Tyr-DTrp-DTrp-Phe-Lys-$NH_2$, Ac-DbetaNal-Leu-Pro-$NH_2$, pAla-Trp-DTrp-DTrp-Orn-$NH_2$, DVal-DαNal-DTrp-Phe-Arg-$NH_2$, DLeu-DαNal-DTrp-Phe-Arg-$NH_2$, CyclohexylAla-DαNal-DTrp-Phe-Arg-$NH_2$, DTp-DαNal-DTrp-Phe-Arg-$NH_2$, DAla-DβNal-DPro-Phe-Arg-$NH_2$, Ac- DαNal-DTrp-Phe-Arg-$NH_2$, DαNal-DTrp-Phe-Arg-$NH_2$, His-DTrp-DTrp-Lys-$NH_2$, Ac-DpNal-DTrp-$NH_2$, αAib-DTrp-DcyclohexylAla-$NH_2$, αAib-DTrp-DAla-cyclohexylAla-$NH_2$, DAla-DcyclohexylAla-Ala-Ala-Phe-DPhe-Nle-$NH_2$, DPhe-Ala-Phe-DPal-$NH_2$, DPhe-Ala-Phe-DPhe-Lys-$NH_2$, DLys-Tyr-DTrp-DTrp-Phe-$NH_2$, Ac-DLys-Tyr-DTrp-DTrp-Phe-$NH_2$, Arg-DTrp-Leu-Tyr-Trp-Pro(cyclic Arg-Pro), Ac-DβNal-PicLys-ILys-DPhe-NH2, DPal-Phe-DTrp-Phe-Met-$NH_2$, DPhe-Trp-DPhe-Phe-Met-$NH_2$, DPal-Trp-DPhe-Phe-Met-$NH_2$, pAla-Pal-DTrp-DTrp-Orn-$NH_2$, αγAbu-Trp-DTrp-DTrp-Orn-$NH_2$, βAla-Trp-DTrp-DTrp-Lys-$NH_2$, γAbu-Trp-DTrp-DTrp-Orn-$NH_2$, Ava-Trp-DTrp-DTrp-Orn-$NH_2$, DLys-Tyr-DTrp-Ala-Trp-DPhe-$NH_2$, His-DTrp-DArg-Trp-DPhe-$NH_2$, <Glu-His-Trp-DSer-DArg-$NH_2$, DPhe-DPhe-DTrp-Met-DLys-$NH_2$,0-(2-methylallyl) benzophonone oxime, (R)-2-amino-3-(1H-indol-3-yl)-1-(4-phenylpiperidin-1-yl)propan-1-one, N-((R)-1-((R)-1-((S)-3-(1H-indol-3-yl)-1-oxo-1-(4-phenylpiperidin-1-yl)propan-2-ylamino)-6-amino-1-oxohexan-2-ylamino)-3-hydroxy-1-oxopropan-2-yl)benzamide, (S)-N-((S)-3-(1H-indol-3-yl)-1-oxo-1-(4-phenylpiperidin-1-yl)propan-2-yl)-6-acetamido-2-((S)-2-amino-3-(benzyloxy)propanamido)hexanamide, (S)-N-((R)-3-(1H-indol-3-yl)-1-oxo-1-(4-phenylpiperidin-1-yl) propan-2-yl)-2-((S)-2-acetamido-3-(benzyloxy) propanamido)-6-aminohexanamide, (R)-N-(3-(1H-indol-3-yl)-1-(4-(2-methoxyphenyl)piperidin-1-yl)-1-oxopropan-2-yl)-4-aminobutanamide, (R)-N-(3-(1H-indol-3-yl)-1-(4-(2-methoxyphenyl)piperidin-1-yl)-1-oxopropan-2-yl)-2-amino-2-methylpropanamide, methyl 3-(p-tolylcarbamoyl)-2-naphthoate, ethyl 3-(4-(2-methoxyphenyl)piperidine-1-carbonyl)-2-naphthoate, 3-(2-methoxyphenylcarbamoyl)-2-naphthoate, (S)-2,4-diamino-N-((R)-3-(naphthalen-2-ylmethoxy)-1-oxo-1-(4-phenylpiperidin-1-yl)propan-2-yl) butanamide, naphthalene-2,3-diylbis((4-(2-methoxyphenyl) piperazin-1-yl)methanone), (R)-2-amino-N-(3-(benzyloxy)-1-oxo-1-(4-phenylpiperazin-1-yl)propan-2-yl)-2-methylpropanamide, or (R)-2-amino-3-(benzyloxy)-1-(4-phenylpiperazin-1-yl)propan-1-one.

Examples of GnRH analogues suitable for use as a TM in the present invention include those known from, for example, EP171477, WO96/033729, WO92/022322, WO92/013883, and WO91/05563, each of which is herein incorporated by reference thereto. Specific examples comprise: (NAcDQal$^{1}$, DPtf$^{2}$,DPAI$^{3}$,cjsPzACAla$^{5}$,DPicLys$^{6}$,DAla$^{10}$)LHRH; NAcDNal$^{1}$,DpCIPhe$^{2}$,DPal$^{3}$,cjsPzACAla$^{5}$,DNicLys$^{6}$,ILys$^{8}$, DAla$^{10}$)LHRH; (NAcDNal$^{1}$,DpCIPhe$^{2}$,DPal$^{3}$,Thr$^{4}$,PicLys$^{5}$, DPicLys$^{6}$,ILys$^{8}$,DAla$^{10}$)LHRH; (NAcDNal$^{1}$,DpCIPhe$^{2}$, DPal$^{3}$,PicLys$^{5}$,DPicLys$^{6}$,Thr$^{7}$,ILys$^{8}$,DAla$^{10}$)LHRH; (NapDThr$^{1}$, DpCIPhe$^{2}$, DPal$^{3}$, PicLys$^{5}$,DPicLys$^{6}$,ILys$^{8}$, DAla$^{10}$)LHRH; (NAcDNal$^{1}$, DpCIPhe$^{2}$,DPal$^{3}$,NicLys$^{5}$, DNicLys$^{6}$,Thr$^{7}$,ILys$^{8}$,DAla$^{10}$)LHRH; (NAcDNal$^{1}$, DpCI-Phe$^{2}$,DPal$^{3}$,Thr$^{4}$NicLys$^{5}$,DNicLys$^{6}$,Thr$^{7}$,ILys$^{8}$,DAla$^{10}$) LHRH; (NAcDNal$^{1}$,DpCIPhe$^{2}$,DPal$^{3}$,PicLys$^{5}$,D(PicSar) Lys$^{6}$,ILys$^{8}$,DAla$^{10}$)LHRH' (NAcDNal$^{1}$,DpCIPhe$^{2}$,DPal$^{3}$,D (PicSar)Lys$^{6}$,ILys$^{8}$,DAla$^{10}$)LHRH; (NAcDNal$^{1}$,DpCIPhe$^{2}$, DPal$^{3}$,PicLys$^{5}$,D(6ANic)Lys$^{6}$,ILys$^{8}$,DAla$^{10}$)LHRH; (NAcDNal$^{1}$,DpCIPhe$^{2}$,DPal$^{3}$,PicLys$^{5}$,D(6ANic)Orn$^{6}$,ILys$^{8}$, DAla$^{10}$)LHRH; (NAcDQal$^{1}$,DCpa$^{2}$,DPal$^{3}$,cisPzACAla$^{5}$, DPicLys$^{6}$,NLeu$^{7}$,ILys$^{8}$,DAla$^{10}$)LHRH; (NAcDNal$^{1}$,DCpa$^{2}$, DPal$^{3}$.DPicLys$^{5}$,DAPhe(PicSar)$^{\beta}$,ILys$^{8}$,DAla$^{10}$)LHRH; NAcDQal$^{1}$,DCpa$^{2}$,DPal$^{3}$,PicLys$^{5}$,DPal$^{6}$,ILys$^{8}$,DAla$^{10}$) LHRH; (NAcDNal$^{1}$,DCpa$^{2}$,DPal$^{3}$,PicLys$^{5}$,DOrn(ACyp)$^{6}$, ILys$^{8}$,DAla$^{10}$)LHRH; N-acetyl-D-beta-Nal-D-Phe-D-Phe-Ser-Tyr-D-Lys(cyclo-pentyl)-Phe-Arg-Pro-D-Ala-$NH_2$; N-acetyl-D-ϕ-Nal-D-Phe-D-Phe-Ser-Tyr-D-Lys(cyclopentyl)-Phe-Lys(cyclopentyl)-Pro-D-Ala-$NH_2$; N-acetyl-D-beta-Nal-D-Phe-D-Phe-Ser-Tyr-D-Arg-Phe-(isopropyl)D-Lys-Pro-D-Ala-$NH_2$; N-acetyl-D-beta-Nal-D-Phe-D-Phe-Ser-Tyr-D-Lys(benzyl)-Phe-Arg-Pro-D-Ala-$NH_2$; N-acetyl-D-beta-Nal-D-Phe-D-Phe-Ser-Tyr-D-Lys(Cl-benzyl)-Phe-Arg-Pro-D-Ala-$NH_2$; N-acetyl-D-beta-Nal-D-Phe-D-Phe-Ser-Tyr-D-Lys(heptyl)-Phe-Arg-Pro-D-Ala-$NH_2$; N-acetyl-D-beta-Nal-D-Phe-D-Phe-Ser-Tyr-D-Arg-Phe-Lys-(t-butylmethyl)-Pro-D-Ala-$NH_2$; N-acetyl-D-beta-Nal-D-Phe-D-Phe-Ser-Tyr-D-Arg-Phe-Lys-(4-methyl-benzyl)-Pro-D-Ala-$NH_2$; N-acetyl-D-beta-Nal-D-Phe-D-Phe-Ser-Tyr-D-Arg-Phe-Lys-(benzyl)-Pro-D-Ala-$NH_2$; N-acetyl-D-beta-Nal-D-p-Cl-Phe-D-Trp-Ser-Tyr-D-p-$NH_2$-Phe-Phe-(isopropyl)Lys-Pro-D-Ala-$NH_2$; N-acetyl-D-beta-Nal-D-Phe-D-Phe-Ser-Tyr-D-Lys(heptyl)-Phe-Lys-(heptyl)-Pro-D-Ala-$NH_2$; N-acetyl-D-3-Nal-D-Phe-D-Phe-Ser-Tyr-D-Lys (1-butylpentyl)-Phe-Lys(1-butylpentyl)-Arg-Pro-D-Ala-$NH_2$.

Examples of urotensin analogues suitable for use as a TM of the present invention comprise: Cpa-c [D-Cys-Phe-Trp-Lys-Thr-Cys]-Val-NH2; and Asp-c[Cys-Phe-Trp-Lys-Tyr-Cys]-Val-OH.

The polypeptides of the present invention lack a functional $H_C$ domain of a clostridial neurotoxin. Accordingly, said polypeptides are not able to bind rat synaptosomal membranes (via a clostridial $H_C$ component) in binding assays as described in Shone et al. (1985) Eur. J. Biochem. 151, 75-82. In a preferred embodiment, the polypeptides preferably lack the last 50 C-terminal amino acids of a clostridial neurotoxin holotoxin. In another embodiment, the polypeptides preferably lack the last 100, preferably the last 150, more preferably the last 200, particularly preferably the last 250, and most preferably the last 300 C-terminal amino acid residues of a clostridial neurotoxin holotoxin. Alternatively, the Hc binding activity may be negated/reduced by mutagenesis—by way of example, referring to BoNT/A for convenience, modification of one or two amino acid residue mutations (W1266 to L and Y1267 to F) in the ganglioside binding pocket causes the $H_C$ region to lose its receptor binding function. Analogous mutations may be made to non-serotype A clostridial peptide components, e.g. a construct based on botulinum B with mutations (W1262 to L and Y1263 to F) or botulinum E (W1224 to L and Y1225 to F). Other mutations to the active site achieve the same ablation of Hc receptor binding activity, e.g. Y1267S in botulinum type A toxin and the corresponding highly conserved residue in the other clostridial neurotoxins. Details of this and other mutations are described in Rummel et al (2004) (Molecular Microbiol. 51:631-634), which is hereby incorporated by reference thereto.

In another embodiment, the polypeptides of the present invention lack a functional $H_C$ domain of a clostridial neurotoxin and also lack any functionally equivalent TM. Accordingly, said polypeptides lack the natural binding function of a clostridial neurotoxin and are not able to bind rat synaptosomal membranes (via a clostridial $H_C$ component, or via any functionally equivalent TM) in binding assays as described in Shone et al. (1985) Eur. J. Biochem. 151, 75-82.

The $H_C$ peptide of a native clostridial neurotoxin comprises approximately 400-440 amino acid residues, and consists of two functionally distinct domains of approximately 25 kDa each, namely the N-terminal region (commonly referred to as the $H_{CN}$ peptide or domain) and the C-terminal region (commonly referred to as the $H_{CC}$ peptide or domain). This fact is confirmed by the following publications, each of which is herein incorporated in its entirety by reference thereto: Umland TC (1997) Nat. Struct. Biol. 4: 788-792; Herreros J (2000) Biochem. J. 347: 199-204; Halpern J (1993) J. Biol. Chem. 268: 15, pp. 11188-11192; Rummel A (2007) PNAS 104: 359-364; Lacey DB (1998) Nat. Struct. Biol. 5: 898-902;

Knapp (1998) Am. Cryst. Assoc. Abstract Papers 25: 90; Swaminathan and Eswaramoorthy (2000) Nat. Struct. Biol. 7: 1751-1759; and Rummel A (2004) Mol. Microbiol. 51(3), 631-643. Moreover, it has been well documented that the C-terminal region ($H_{CC}$), which constitutes the C-terminal 160-200 amino acid residues, is responsible for binding of a clostridial neurotoxin to its natural cell receptors, namely to nerve terminals at the neuromuscular junction—this fact is also confirmed by the above publications. Thus, reference throughout this specification to a clostridial heavy-chain lacking a functional heavy chain $H_C$ peptide (or domain) such that the heavy-chain is incapable of binding to cell surface receptors to which a native clostridial neurotoxin binds means that the clostridial heavy-chain simply lacks a functional $H_{CC}$ peptide. In other words, the $H_{CC}$ peptide region is either partially or wholly deleted, or otherwise modified (e.g. through conventional chemical or proteolytic treatment) to inactivate its native binding ability for nerve terminals at the neuromuscular junction.

Thus, in one embodiment, a clostridial $H_N$ peptide of the present invention lacks part of a C-terminal peptide portion ($H_{CC}$) of a clostridial neurotoxin and thus lacks the $H_C$ binding function of native clostridial neurotoxin. By way of example, in one embodiment, the C-terminally extended clostridial $H_N$ peptide lacks the C-terminal 40 amino acid residues, or the C-terminal 60 amino acid residues, or the C-terminal 80 amino acid residues, or the C-terminal 100 amino acid residues, or the C-terminal 120 amino acid residues, or the C-terminal 140 amino acid residues, or the C-terminal 150 amino acid residues, or the C-terminal 160 amino acid residues of a clostridial neurotoxin heavy-chain. In another embodiment, the clostridial $H_N$ peptide of the present invention lacks the entire C-terminal peptide portion ($H_{CC}$) of a clostridial neurotoxin and thus lacks the $H_C$ binding function of native clostridial neurotoxin. By way of example, in one embodiment, the clostridial $H_N$ peptide lacks the C-terminal 165 amino acid residues, or the C-terminal 170 amino acid residues, or the C-terminal 175 amino acid residues, or the C-terminal 180 amino acid residues, or the C-terminal 185 amino acid residues, or the C-terminal 190 amino acid residues, or the C-terminal 195 amino acid residues of a clostridial neurotoxin heavy-chain. By way of further example, the clostridial $H_N$ peptide of the present invention lacks a clostridial $H_{CC}$ reference sequence selected from the group consisting of:

Botulinum type A neurotoxin—amino acid residues (Y1111-L1296)

Botulinum type B neurotoxin—amino acid residues (Y1098-E1291)

Botulinum type C neurotoxin—amino acid residues (Y1112-E1291)

Botulinum type D neurotoxin—amino acid residues (Y1099-E1276)

Botulinum type E neurotoxin—amino acid residues (Y1086-K1252)

Botulinum type F neurotoxin—amino acid residues (Y1106-E1274)

Botulinum type G neurotoxin—amino acid residues (Y1106-E1297)

Tetanus neurotoxin—amino acid residues (Y1128-D1315).

The above-identified reference sequences should be considered a guide as slight variations may occur according to sub-serotypes.

The protease of the present invention embraces all non-cytotoxic proteases that are capable of cleaving one or more proteins of the exocytic fusion apparatus in eukaryotic cells.

The protease of the present invention is preferably a bacterial protease (or fragment thereof). More preferably the bacterial protease is selected from the genera *Clostridium* or *Neisseria/Streptococcus* (e.g. a clostridial L-chain, or a neisserial IgA protease preferably from *N. gonorrhoeae* or *S. pneumoniae*).

The present invention also embraces variant non-cytotoxic proteases (ie. variants of naturally-occurring protease molecules), so long as the variant proteases still demonstrate the requisite protease activity. By way of example, a variant may have at least 70%, preferably at least 80%, more preferably at least 90%, and most preferably at least 95 or at least 98% amino acid sequence homology with a reference protease sequence. Thus, the term variant includes non-cytotic proteases having enhanced (or decreased) endopeptidase activity—particular mention here is made to the increased $K_{cat}/K_m$ of BoNT/A mutants Q161A, E54A, and K165L see Ahmed, S. A. (2008) Protein J. DOI 10.1007/s10930-007-9118-8, which is incorporated by reference thereto. The term fragment, when used in relation to a protease, typically means a peptide having at least 150, preferably at least 200, more preferably at least 250, and most preferably at least 300 amino acid residues of the reference protease. As with the TM 'fragment' component (discussed above), protease 'fragments' of the present invention embrace fragments of variant proteases based on a reference sequence.

The protease of the present invention preferably demonstrates a serine or metalloprotease activity (e.g. endopeptidase activity). The protease is preferably specific for a SNARE protein (e.g. SNAP-25, synaptobrevin/VAMP, or syntaxin). Particular mention is made to the protease domains of neurotoxins, for example the protease domains of bacterial neurotoxins. Thus, the present invention embraces the use of neurotoxin domains, which occur in nature, as well as recombinantly prepared versions of said naturally-occurring neurotoxins.

Exemplary neurotoxins are produced by clostridia, and the term clostridial neurotoxin embraces neurotoxins produced by *C. tetani* (TeNT), and by *C. botulinum* (BoNT) serotypes A-G, as well as the closely related BoNT-like neurotoxins produced by *C. baratii* and *C. butyricum*. The above-mentioned abbreviations are used throughout the present specification. For example, the nomenclature BoNT/A denotes the source of neurotoxin as BoNT (serotype A). Corresponding nomenclature applies to other BoNT serotypes.

BoNTs are the most potent toxins known, with median lethal dose (LD50) values for mice ranging from 0.5 to 5 ng/kg depending on the serotype. BoNTs are adsorbed in the gastrointestinal tract, and, after entering the general circulation, bind to the presynaptic membrane of cholinergic nerve terminals and prevent the release of their neurotransmitter acetylcholine. BoNT/B, BoNT/D, BoNT/F and BoNT/G cleave synaptobrevin/vesicle-associated membrane protein (VAMP); BoNT/C, BoNT/A and BoNT/E cleave the synaptosomal-associated protein of 25 kDa (SNAP-25); and BoNT/C cleaves syntaxin.

BoNTs share a common structure, being di-chain proteins of ~150 kDa, consisting of a heavy chain (H-chain) of ~100 kDa covalently joined by a single disulfide bond to a light chain (L-chain) of ~50 kDa. The H-chain consists of two domains, each of ~50 kDa. The C-terminal domain ($H_C$) is required for the high-affinity neuronal binding, whereas the N-terminal domain ($H_N$) is proposed to be involved in membrane translocation. The L-chain is a zinc-dependent metalloprotease responsible for the cleavage of the substrate SNARE protein.

The term L-chain fragment means a component of the L-chain of a neurotoxin, which fragment demonstrates a metalloprotease activity and is capable of proteolytically cleaving a vesicle and/or plasma membrane associated protein involved in cellular exocytosis.

Examples of suitable protease (reference) sequences include:

| | |
|---|---|
| Botulinum type A neurotoxin | amino acid residues (1-448) |
| Botulinum type B neurotoxin | amino acid residues (1-440) |
| Botulinum type C neurotoxin | amino acid residues (1-441) |
| Botulinum type D neurotoxin | amino acid residues (1-445) |
| Botulinum type E neurotoxin | amino acid residues (1-422) |
| Botulinum type F neurotoxin | amino acid residues (1-439) |
| Botulinum type G neurotoxin | amino acid residues (1-441) |
| Tetanus neurotoxin | amino acid residues (1-457) |
| IgA protease | amino acid residues (1-959)* |

*Pohlner, J. et al. (1987). Nature 325, pp. 458-462, which is hereby incorporated by reference thereto.

The above-identified reference sequence should be considered a guide as slight variations may occur according to sub-serotypes. By way of example, US 2007/0166332 (hereby incorporated by reference thereto) cites slightly different clostridial sequences:

| | |
|---|---|
| Botulinum type A neurotoxin | amino acid residues (M1-K448) |
| Botulinum type B neurotoxin | amino acid residues (M1-K441) |
| Botulinum type C neurotoxin | amino acid residues (M1-K449) |
| Botulinum type D neurotoxin | amino acid residues (M1-R445) |
| Botulinum type E neurotoxin | amino acid residues (M1-R422) |
| Botulinum type F neurotoxin | amino acid residues (M1-K439) |
| Botulinum type G neurotoxin | amino acid residues (M1-K446) |
| Tetanus neurotoxin | amino acid residues (M1-A457) |

A variety of clostridial toxin fragments comprising the light chain can be useful in aspects of the present invention with the proviso that these light chain fragments can specifically target the core components of the neurotransmitter release apparatus and thus participate in executing the overall cellular mechanism whereby a clostridial toxin proteolytically cleaves a substrate. The light chains of clostridial toxins are approximately 420-460 amino acids in length and comprise an enzymatic domain. Research has shown that the entire length of a clostridial toxin light chain is not necessary for the enzymatic activity of the enzymatic domain. As a non-limiting example, the first eight amino acids of the BoNT/A light chain are not required for enzymatic activity. As another non-limiting example, the first eight amino acids of the TeNT light chain are not required for enzymatic activity. Likewise, the carboxyl-terminus of the light chain is not necessary for activity. As a non-limiting example, the last 32 amino acids of the BoNT/A light chain (residues 417-448) are not required for enzymatic activity. As another non-limiting example, the last 31 amino acids of the TeNT light chain (residues 427-457) are not required for enzymatic activity. Thus, aspects of this embodiment can include clostridial toxin light chains comprising an enzymatic domain having a length of, for example, at least 350 amino acids, at least 375 amino acids, at least 400 amino acids, at least 425 amino acids and at least 450 amino acids. Other aspects of this embodiment can include clostridial toxin light chains comprising an enzymatic domain having a length of, for example, at most 350 amino acids, at most 375 amino acids, at most 400 amino acids, at most 425 amino acids and at most 450 amino acids.

The non-cytotoxic protease component of the present invention preferably comprises a BoNT/A, BoNT/B or BoNT/D serotype L-chain (or fragment or variant thereof).

The polypeptides of the present invention, especially the protease component thereof, may be PEGylated—this may help to increase stability, for example duration of action of the protease component. PEGylation is particularly preferred when the protease comprises a BoNT/A, B or $C_1$ protease. PEGylation preferably includes the addition of PEG to the N-terminus of the protease component. By way of example, the N-terminus of a protease may be extended with one or more amino acid (e.g. cysteine) residues, which may be the same or different. One or more of said amino acid residues may have its own PEG molecule attached (e.g. covalently attached) thereto. An example of this technology is described in WO2007/104567, which is incorporated in its entirety by reference thereto.

A Translocation Domain is a molecule that enables translocation of a protease into a target cell such that a functional expression of protease activity occurs within the cytosol of the target cell. Whether any molecule (e.g. a protein or peptide) possesses the requisite translocation function of the present invention may be confirmed by any one of a number of conventional assays.

For example, Shone C. (1987) describes an in vitro assay employing liposomes, which are challenged with a test molecule. Presence of the requisite translocation function is confirmed by release from the liposomes of $K^+$ and/or labelled NAD, which may be readily monitored [see Shone C. (1987) Eur. J. Biochem; vol. 167(1): pp. 175-180].

A further example is provided by Blaustein R. (1987), which describes a simple in vitro assay employing planar phospholipid bilayer membranes. The membranes are challenged with a test molecule and the requisite translocation function is confirmed by an increase in conductance across said membranes [see Blaustein (1987) FEBS Letts; vol. 226, no. 1: pp. 115-120].

Additional methodology to enable assessment of membrane fusion and thus identification of Translocation Domains suitable for use in the present invention are provided by Methods in Enzymology Vol 220 and 221, Membrane Fusion Techniques, Parts A and B, Academic Press 1993.

The present invention also embraces variant translocation domains, so long as the variant domains still demonstrate the requisite translocation activity. By way of example, a variant may have at least 70%, preferably at least 80%, more preferably at least 90%, and most preferably at least 95% or at least 98% amino acid sequence homology with a reference translocation domain. The term fragment, when used in relation to a translocation domain, means a peptide having at least 20, preferably at least 40, more preferably at least 80, and most preferably at least 100 amino acid residues of the reference translocation domain. In the case of a clostridial translocation domain, the fragment preferably has at least 100, preferably at least 150, more preferably at least 200, and most preferably at least 250 amino acid residues of the reference translocation domain (eg. $H_N$ domain). As with the TM 'fragment' component (discussed above), translocation 'fragments' of the present invention embrace fragments of variant translocation domains based on the reference sequences.

The Translocation Domain is preferably capable of formation of ion-permeable pores in lipid membranes under conditions of low pH. Preferably it has been found to use only those portions of the protein molecule capable of pore-formation within the endosomal membrane.

The Translocation Domain may be obtained from a microbial protein source, in particular from a bacterial or viral protein source. Hence, in one embodiment, the Translocation Domain is a translocating domain of an enzyme, such as a bacterial toxin or viral protein.

It is well documented that certain domains of bacterial toxin molecules are capable of forming such pores. It is also known that certain translocation domains of virally expressed membrane fusion proteins are capable of forming such pores. Such domains may be employed in the present invention.

The Translocation Domain may be of a clostridial origin, such as the $H_N$ domain (or a functional component thereof). $H_N$ means a portion or fragment of the H-chain of a clostridial neurotoxin approximately equivalent to the amino-terminal half of the H-chain, or the domain corresponding to that fragment in the intact H-chain. The H-chain lacks the natural binding function of the $H_C$ component of the H-chain. In this regard, the $H_C$ function may be removed by deletion of the $H_C$ amino acid sequence (either at the DNA synthesis level, or at the post-synthesis level by nuclease or protease treatment). Alternatively, the $H_C$ function may be inactivated by chemical or biological treatment. Thus, the H-chain is incapable of binding to the Binding Site on a target cell to which native clostridial neurotoxin (i.e. holotoxin) binds.

Examples of suitable (reference) Translocation Domains include:

| | |
|---|---|
| Botulinum type A neurotoxin | amino acid residues (449-871) |
| Botulinum type B neurotoxin | amino acid residues (441-858) |
| Botulinum type C neurotoxin | amino acid residues (442-866) |
| Botulinum type D neurotoxin | amino acid residues (446-862) |
| Botulinum type E neurotoxin | amino acid residues (423-845) |
| Botulinum type F neurotoxin | amino acid residues (440-864) |
| Botulinum type G neurotoxin | amino acid residues (442-863) |
| Tetanus neurotoxin | amino acid residues (458-879) |

The above-identified reference sequence should be considered a guide as slight variations may occur according to sub-serotypes. By way of example, US 2007/0166332 (hereby incorporated by reference thereto) cites slightly different clostridial sequences:

| | |
|---|---|
| Botulinum type A neurotoxin | amino acid residues (A449-K871) |
| Botulinum type B neurotoxin | amino acid residues (A442-S858) |
| Botulinum type C neurotoxin | amino acid residues (T450-N866) |
| Botulinum type D neurotoxin | amino acid residues (D446-N862) |
| Botulinum type E neurotoxin | amino acid residues (K423-K845) |
| Botulinum type F neurotoxin | amino acid residues (A440-K864) |
| Botulinum type G neurotoxin | amino acid residues (S447-S863) |
| Tetanus neurotoxin | amino acid residues (S458-V879) |

In the context of the present invention, a variety of Clostridial toxin $H_N$ regions comprising a translocation domain can be useful in aspects of the present invention with the proviso that these active fragments can facilitate the release of a non-cytotoxic protease (e.g. a clostridial L-chain) from intracellular vesicles into the cytoplasm of the target cell and thus participate in executing the overall cellular mechanism whereby a clostridial toxin proteolytically cleaves a substrate. The $H_N$ regions from the heavy chains of Clostridial toxins are approximately 410-430 amino acids in length and comprise a translocation domain. Research has shown that the entire length of a $H_N$ region from a Clostridial toxin heavy chain is not necessary for the translocating activity of the translocation domain. Thus, aspects of this embodiment can include clostridial toxin $H_N$ regions comprising a translocation domain having a length of, for example, at least 350 amino acids, at least 375 amino acids, at least 400 amino acids and at least 425 amino acids. Other aspects of this embodiment can include clostridial toxin $H_N$ regions comprising translocation domain having a length of, for example, at most 350 amino acids, at most 375 amino acids, at most 400 amino acids and at most 425 amino acids.

For further details on the genetic basis of toxin production in *Clostridium botulinum* and *C. tetani*, we refer to Henderson et al (1997) in *The Clostridia: Molecular Biology and Pathogenesis*, Academic press.

The term $H_N$ embraces naturally-occurring neurotoxin $H_N$ portions, and modified $H_N$ portions having amino acid sequences that do not occur in nature and/or synthetic amino acid residues, so long as the modified $H_N$ portions still demonstrate the above-mentioned translocation function.

Alternatively, the Translocation Domain may be of a non-clostridial origin. Examples of non-clostridial (reference) Translocation Domain origins include, but not be restricted to, the translocation domain of diphtheria toxin [O'Keefe et al., Proc. Natl. Acad. Sci. USA (1992) 89, 6202-6206; Silverman et al, J. Biol. Chem. (1993) 269, 22524-22532; and London, E. (1992) *Biochem. Biophys. Acta.,* 1112, pp. 25-51], the translocation domain of *Pseudomonas* exotoxin type A [Prior et al. Biochemistry (1992) 31, 3555-3559], the translocation domains of anthrax toxin [Blanke et al. Proc. Natl. Acad. Sci. USA (1996) 93, 8437-8442], a variety of fusogenic or hydrophobic peptides of translocating function [Plank et al. J. Biol. Chem. (1994) 269, 12918-12924; and Wagner et al (1992) *PNAS,* 89, pp. 7934-7938], and amphiphilic peptides [Murata et al (1992) *Biochem.,* 31, pp. 1986-1992]. The Translocation Domain may mirror the Translocation Domain present in a naturally-occurring protein, or may include amino acid variations so long as the variations do not destroy the translocating ability of the Translocation Domain.

Particular examples of viral (reference) Translocation Domains suitable for use in the present invention include certain translocating domains of virally expressed membrane fusion proteins. For example, Wagner et al. (1992) and Murata et al. (1992) describe the translocation (i.e. membrane fusion and vesiculation) function of a number of fusogenic and amphiphilic peptides derived from the N-terminal region of influenza virus haemagglutinin. Other virally expressed membrane fusion proteins known to have the desired translocating activity are a translocating domain of a fusogenic peptide of Semliki Forest Virus (SFV), a translocating domain of vesicular stomatitis virus (VSV) glycoprotein G, a translocating domain of SER virus F protein and a translocating domain of Foamy virus envelope glycoprotein. Virally encoded Aspike proteins have particular application in the context of the present invention, for example, the E1 protein of SFV and the G protein of the G protein of VSV.

Use of the (reference) Translocation Domains listed in Table (below) includes use of sequence variants thereof. A variant may comprise one or more conservative nucleic acid substitutions and/or nucleic acid deletions or insertions, with the proviso that the variant possesses the requisite translocating function. A variant may also comprise one or more amino acid substitutions and/or amino acid deletions or insertions, so long as the variant possesses the requisite translocating function.

| Translocation Domain source | Amino acid residues | References |
|---|---|---|
| Diphtheria toxin | 194-380 | Silverman et al., 1994, J. Biol. Chem. 269, 22524-22532<br>London E., 1992, Biochem. Biophys. Acta., 1113, 25-51 |
| Domain II of pseudomonas exotoxin | 405-613 | Prior et al., 1992, Biochemistry 31, 3555-3559<br>Kihara & Pastan, 1994, Bioconj Chem. 5, 532-538 |
| Influenza virus haemagglutinin | GLFGAIAGFIENGWE GMIDGWYG, and Variants thereof | Plank et al., 1994, J. Biol. Chem. 269, 12918-12924<br>Wagner et al., 1992, PNAS, 89, 7934-7938<br>Murata et al., 1992, Biochemistry 31, 1986-1992 |
| Semliki Forest virus fusogenic protein | Translocation domain | Kielian et al., 1996, J Cell Biol. 134(4), 863-872 |
| Vesicular Stomatitis virus glycoprotein G | 118-139 | Yao et al., 2003, Virology 310(2), 319-332 |
| SER virus F protein | Translocation domain | Seth et al., 2003, J Virol 77(11) 6520-6527 |
| Foamy virus envelope glycoprotein | Translocation domain | Picard-Maureau et al., 2003, J Virol. 77(8), 4722-4730 |

The polypeptides of the present invention may further comprise a translocation facilitating domain. Said domain facilitates delivery of the non-cytotoxic protease into the cytosol of the target cell and are described, for example, in WO 08/008803 and WO 08/008805, each of which is herein incorporated by reference thereto.

By way of example, suitable translocation facilitating domains include an enveloped virus fusogenic peptide domain, for example, suitable fusogenic peptide domains include influenzavirus fusogenic peptide domain (eg. influenza A virus fusogenic peptide domain of 23 amino acids), alphavirus fusogenic peptide domain (eg. Semliki Forest virus fusogenic peptide domain of 26 amino acids), vesiculovirus fusogenic peptide domain (eg. vesicular stomatitis virus fusogenic peptide domain of 21 amino acids), respirovirus fusogenic peptide domain (eg. Sendai virus fusogenic peptide domain of 25 amino acids), morbiliivirus fusogenic peptide domain (eg. Canine distemper virus fusogenic peptide domain of 25 amino acids), avulavirus fusogenic peptide domain (eg. Newcastle disease virus fusogenic peptide domain of 25 amino acids), henipavirus fusogenic peptide domain (eg. Hendra virus fusogenic peptide domain of 25 amino acids), metapneumovirus fusogenic peptide domain (eg. Human metapneumovirus fusogenic peptide domain of 25 amino acids) or spumavirus fusogenic peptide domain such as simian foamy virus fusogenic peptide domain; or fragments or variants thereof.

By way of further example, a translocation facilitating domain may comprise a Clostridial toxin $H_{CN}$ domain or a fragment or variant thereof. In more detail, a Clostridial toxin $H_{CN}$ translocation facilitating domain may have a length of at least 200 amino acids, at least 225 amino acids, at least 250 amino acids, at least 275 amino acids. In this regard, a Clostridial toxin $H_{CN}$ translocation facilitating domain preferably has a length of at most 200 amino acids, at most 225 amino acids, at most 250 amino acids, or at most 275 amino acids. Specific (reference) examples include:

| | |
|---|---|
| Botulinum type A neurotoxin | amino acid residues (872-1110) |
| Botulinum type B neurotoxin | amino acid residues (859-1097) |
| Botulinum type C neurotoxin | amino acid residues (867-1111) |

-continued

| | |
|---|---|
| Botulinum type D neurotoxin | amino acid residues (863-1098) |
| Botulinum type E neurotoxin | amino acid residues (846-1085) |
| Botulinum type F neurotoxin | amino acid residues (865-1105) |
| Botulinum type G neurotoxin | amino acid residues (864-1105) |
| Tetanus neurotoxin | amino acid residues (880-1127) |

The above sequence positions may vary a little according to serotype/sub-type, and further examples of suitable (reference) Clostridial toxin $H_{CN}$ domains include:

| | |
|---|---|
| Botulinum type A neurotoxin | amino acid residues (874-1110) |
| Botulinum type B neurotoxin | amino acid residues (861-1097) |
| Botulinum type C neurotoxin | amino acid residues (869-1111) |
| Botulinum type D neurotoxin | amino acid residues (865-1098) |
| Botulinum type E neurotoxin | amino acid residues (848-1085) |
| Botulinum type F neurotoxin | amino acid residues (867-1105) |
| Botulinum type G neurotoxin | amino acid residues (866-1105) |
| Tetanus neurotoxin | amino acid residues (882-1127) |

Any of the above-described facilitating domains may be combined with any of the previously described translocation domain peptides that are suitable for use in the present invention. Thus, by way of example, a non-clostridial facilitating domain may be combined with non-clostridial translocation domain peptide or with clostridial translocation domain peptide. Alternatively, a Clostridial toxin $H_{CN}$ translocation facilitating domain may be combined with a non-clostridal translocation domain peptide. Alternatively, a Clostridial toxin $H_{CN}$ facilitating domain may be combined or with a clostridial translocation domain peptide, examples of which include:

| | |
|---|---|
| Botulinum type A neurotoxin | amino acid residues (449-1110) |
| Botulinum type B neurotoxin | amino acid residues (442-1097) |
| Botulinum type C neurotoxin | amino acid residues (450-1111) |
| Botulinum type D neurotoxin | amino acid residues (446-1098) |
| Botulinum type E neurotoxin | amino acid residues (423-1085) |
| Botulinum type F neurotoxin | amino acid residues (440-1105) |
| Botulinum type G neurotoxin | amino acid residues (447-1105) |
| Tetanus neurotoxin | amino acid residues (458-1127) |

Sequence Homology:

Any of a variety of sequence alignment methods can be used to determine percent identity, including, without limitation, global methods, local methods and hybrid methods, such as, e.g., segment approach methods. Protocols to determine percent identity are routine procedures within the scope of one skilled in the. Global methods align sequences from the beginning to the end of the molecule and determine the best alignment by adding up scores of individual residue pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) Nucleic Acids Research 4673-4680 (1994); and iterative refinement, see, e.g., Osamu Gotoh, Significant Improvement in Accuracy of Multiple Protein. Sequence Alignments by Iterative Refinement as Assessed by Reference to Structural Alignments, 264(4) J. Mol. Biol. 823-838 (1996). Local methods align sequences by identifying one or more conserved motifs shared by all of the input sequences. Non-limiting methods include, e.g., Match-box, see, e.g., Eric Depiereux and Ernest Feytmans, Match-Box: A Fundamentally New Algorithm for the Simultaneous Alignment of Several Protein Sequences, 8(5) CABIOS 501-509 (1992); Gibbs sampling, see, e.g., C. E. Lawrence et al., Detecting Subtle Sequence Signals: A Gibbs Sampling Strategy for Multiple Alignment, 262(5131) Science 208-214 (1993); Align-M, see, e.g., Ivo Van Walle et al., Align-M—A New Algorithm for Multiple Alignment of Highly Divergent Sequences, 20(9) Bioinformatics: 1428-1435 (2004).

Thus, percent sequence identity is determined by conventional methods. See, for example, Altschul et al., *Bull. Math. Bio.* 48:603-16, 1986 and Henikoff and Henikoff, *Proc. Natl. Acad. Sci. USA* 89:10915-19, 1992. Briefly, two amino acid sequences are aligned to optimize the alignment scores using a gap opening penalty of 10, a gap extension penalty of 1, and the "blosum 62" scoring matrix of Henikoff and Henikoff (ibid.) as shown below (amino acids are indicated by the standard one-letter codes).

Alignment Scores for Determining Sequence Identity

| | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 4 | | | | | | | | | | | | | | | | | | | |
| R | −1 | 5 | | | | | | | | | | | | | | | | | | |
| N | −2 | 0 | 6 | | | | | | | | | | | | | | | | | |
| D | −2 | −2 | 1 | 6 | | | | | | | | | | | | | | | | |
| C | 0 | −3 | −3 | −3 | 9 | | | | | | | | | | | | | | | |
| Q | −1 | 1 | 0 | 0 | −3 | 5 | | | | | | | | | | | | | | |
| E | −1 | 0 | 0 | 2 | −4 | 2 | 5 | | | | | | | | | | | | | |
| G | 0 | −2 | 0 | −1 | −3 | −2 | −2 | 6 | | | | | | | | | | | | |
| H | −2 | 0 | 1 | −1 | −3 | 0 | 0 | −2 | 8 | | | | | | | | | | | |
| I | −1 | −3 | −3 | −3 | −1 | −3 | −3 | −4 | −3 | 4 | | | | | | | | | | |
| L | −1 | −2 | −3 | −4 | −1 | −2 | −3 | −4 | −3 | 2 | 4 | | | | | | | | | |
| K | −1 | 2 | 0 | −1 | −3 | 1 | 1 | −2 | −1 | −3 | −2 | 5 | | | | | | | | |
| M | −1 | −1 | −2 | −3 | −1 | 0 | −2 | −3 | −2 | 1 | 2 | −1 | 5 | | | | | | | |
| F | −2 | −3 | −3 | −3 | −2 | −3 | −3 | −3 | −1 | 0 | 0 | −3 | 0 | 6 | | | | | | |
| P | −1 | −2 | −2 | −1 | −3 | −1 | −1 | −2 | −2 | −3 | −3 | −1 | −2 | −4 | 7 | | | | | |
| S | 1 | −1 | 1 | 0 | −1 | 0 | 0 | 0 | −1 | −2 | −2 | 0 | −1 | −2 | −1 | 4 | | | | |
| T | 0 | −1 | 0 | −1 | −1 | −1 | −1 | −2 | −2 | −1 | −1 | −1 | −1 | −2 | −1 | 1 | 5 | | | |
| W | −3 | −3 | −4 | −4 | −2 | −2 | −3 | −2 | −2 | −3 | −2 | −3 | −1 | 1 | −4 | −3 | −2 | 11 | | |
| Y | −2 | −2 | −2 | −3 | −2 | −1 | −2 | −3 | 2 | −1 | −1 | −2 | −1 | 3 | −3 | −2 | −2 | 2 | 7 | |
| V | 0 | −3 | −3 | −3 | −1 | −2 | −2 | −3 | −3 | 3 | 1 | −2 | 1 | −1 | −2 | −2 | 0 | −3 | −1 | 4 |

The percent identity is then calculated as:

$$\frac{\text{Total number of identical matches}}{\left[\begin{array}{c}\text{length of the longer sequence plus the number}\\ \text{of gaps introduced into the longer sequence}\\ \text{in order to align the two sequences}\end{array}\right]}\times 100$$

Substantially homologous polypeptides are characterized as having one or more amino acid substitutions, deletions or additions. These changes are preferably of a minor nature, that is conservative amino acid substitutions (see below) and other substitutions that do not significantly affect the folding or activity of the polypeptide; small deletions, typically of one to about 30 amino acids; and small amino- or carboxyl-terminal extensions, such as an amino-terminal methionine residue, a small linker peptide of up to about 20-25 residues, or an affinity tag.

Conservative Amino Acid Substitutions

Basic:
arginine
lysine
histidine

Acidic:
glutamic acid
aspartic acid

Polar:
glutamine
asparagine

Hydrophobic:
leucine
isoleucine
valine

Aromatic:
phenylalanine
tryptophan
tyrosine

Small:
glycine
alanine
serine
threonine
methionine

In addition to the 20 standard amino acids, non-standard amino acids (such as 4-hydroxyproline, 6-N-methyl lysine, 2-aminoisobutyric acid, isovaline and α-methyl serine) may be substituted for amino acid residues of the polypeptides of the present invention. A limited number of non-conservative amino acids, amino acids that are not encoded by the genetic code, and unnatural amino acids may be substituted for clostridial polypeptide amino acid residues. The polypeptides of the present invention can also comprise non-naturally occurring amino acid residues.

Non-naturally occurring amino acids include, without limitation, trans-3-methylproline, 2,4-methano-proline, cis-4-hydroxyproline, trans-4-hydroxy-proline, N-methylglycine, allo-threonine, methyl-threonine, hydroxy-ethylcysteine, hydroxyethylhomo-cysteine, nitro-glutamine, homoglutamine, pipecolic acid, tert-leucine, norvaline, 2-azaphenylalanine, 3-azaphenyl-alanine, 4-azaphenyl-alanine, and 4-fluorophenylalanine. Several methods are known in the art for incorporating non-naturally occurring amino acid residues into proteins. For example, an in vitro system can be employed wherein nonsense mutations are suppressed using chemically aminoacylated suppressor tRNAs. Methods for synthesizing amino acids and aminoacylating tRNA are known in the art. Transcription and translation of plasmids containing nonsense mutations is carried out in a cell free system comprising an *E. coli* S30 extract and commercially available enzymes and other reagents. Proteins are purified by chromatography. See, for example, Robertson et al., *J. Am. Chem. Soc.* 113:2722, 1991; Ellman et al., *Methods Enzymol.* 202:301, 1991; Chung et al., *Science* 259:806-9, 1993; and Chung et al., *Proc. Natl. Acad. Sci. USA* 90:10145-9, 1993). In a second method, translation is carried out in Xenopus oocytes by microinjection of mutated mRNA and chemically aminoacylated suppressor tRNAs (Turcatti et al., *J. Biol. Chem.* 271:19991-8, 1996). Within a third method, *E. coli* cells are cultured in the absence of a natural amino acid that is to be replaced (e.g., phenylalanine) and in the presence of the desired non-naturally occurring amino acid(s) (e.g., 2-azaphenylalanine, 3-azaphenylalanine, 4-azaphenylalanine, or 4-fluorophenylalanine). The non-naturally occurring amino acid is incorporated into the polypeptide in place of its natural counterpart. See, Koide et al., *Biochem.* 33:7470-6, 1994. Naturally occurring amino acid residues can be converted to non-naturally occurring species by in vitro chemical modification. Chemical modification can be combined with site-directed mutagenesis to further expand the range of substitutions (Wynn and Richards, *Protein Sci.* 2:395-403, 1993).

A limited number of non-conservative amino acids, amino acids that are not encoded by the genetic code, non-naturally occurring amino acids, and unnatural amino acids may be substituted for amino acid residues of polypeptides of the present invention.

Essential amino acids in the polypeptides of the present invention can be identified according to procedures known in the art, such as site-directed mutagenesis or alanine-scanning mutagenesis (Cunningham and Wells, *Science* 244:1081-5, 1989). Sites of biological interaction can also be determined by physical analysis of structure, as determined by such techniques as nuclear magnetic resonance, crystallography, electron diffraction or photoaffinity labeling, in conjunction with mutation of putative contact site amino acids. See, for example, de Vos et al., *Science* 255:306-12, 1992; Smith et al., *J. Mol. Biol.* 224:899-904, 1992; Wlodaver et al., *FEBS Lett.* 309:59-64, 1992. The identities of essential amino acids can also be inferred from analysis of homologies with related components (e.g. the translocation or protease components) of the polypeptides of the present invention.

Multiple amino acid substitutions can be made and tested using known methods of mutagenesis and screening, such as those disclosed by Reidhaar-Olson and Sauer (*Science* 241: 53-7, 1988) or Bowie and Sauer (*Proc. Natl. Acad. Sci. USA* 86:2152-6, 1989). Briefly, these authors disclose methods for simultaneously randomizing two or more positions in a polypeptide, selecting for functional polypeptide, and then sequencing the mutagenised polypeptides to determine the spectrum of allowable substitutions at each position. Other methods that can be used include phage display (e.g., Lowman et al., *Biochem.* 30:10832-7, 1991; Ladner et al., U.S. Pat. No. 5,223,409; Huse, WIPO Publication WO 92/06204) and region-directed mutagenesis (Derbyshire et al., *Gene* 46:145, 1986; Ner et al., *DNA* 7:127, 1988).

Multiple amino acid substitutions can be made and tested using known methods of mutagenesis and screening, such as those disclosed by Reidhaar-Olson and Sauer (*Science* 241: 53-7, 1988) or Bowie and Sauer (*Proc. Natl. Acad. Sci. USA* 86:2152-6, 1989). Briefly, these authors disclose methods for simultaneously randomizing two or more positions in a polypeptide, selecting for functional polypeptide, and then sequencing the mutagenized polypeptides to determine the spectrum of allowable substitutions at each position. Other methods that can be used include phage display (e.g., Lowman et al., Biochem. 30:10832-7, 1991; Ladner et al., U.S. Pat. No. 5,223,409; Huse, WIPO Publication WO 92/06204) and region-directed mutagenesis (Derbyshire et al., *Gene* 46:145, 1986; Ner et al., *DNA* 7:127, 1988).

There now follows a brief description of the FIGS., which illustrate aspects and/or embodiments of the present invention.

FIG. 1—Purification of $LH_N$/D-CT-CST28 Fusion Protein

Using the methodology outlined in Example 5, a $LH_N$/D-CT-CST28 fusion protein was purified from *E. coli* BL21 (DE3) cells. Briefly, the soluble products obtained following cell disruption were applied to a nickel-charged affinity capture column. Bound proteins were eluted with 200 mM imidazole, treated with enterokinase to activate the fusion protein and then re-applied to a second nickel-charged affinity capture column. Samples from the purification procedure were assessed by SDS-PAGE. Lane 1: First nickel chelating Sepharose column eluant, Lane 2: Second nickel chelating Sepharose column eluant under non-reducing conditions, Lane 3: Second nickel chelating Sepharose column eluant under reducing conditions, lane 4: Molecular mass markers (kDa).

Figure 2:
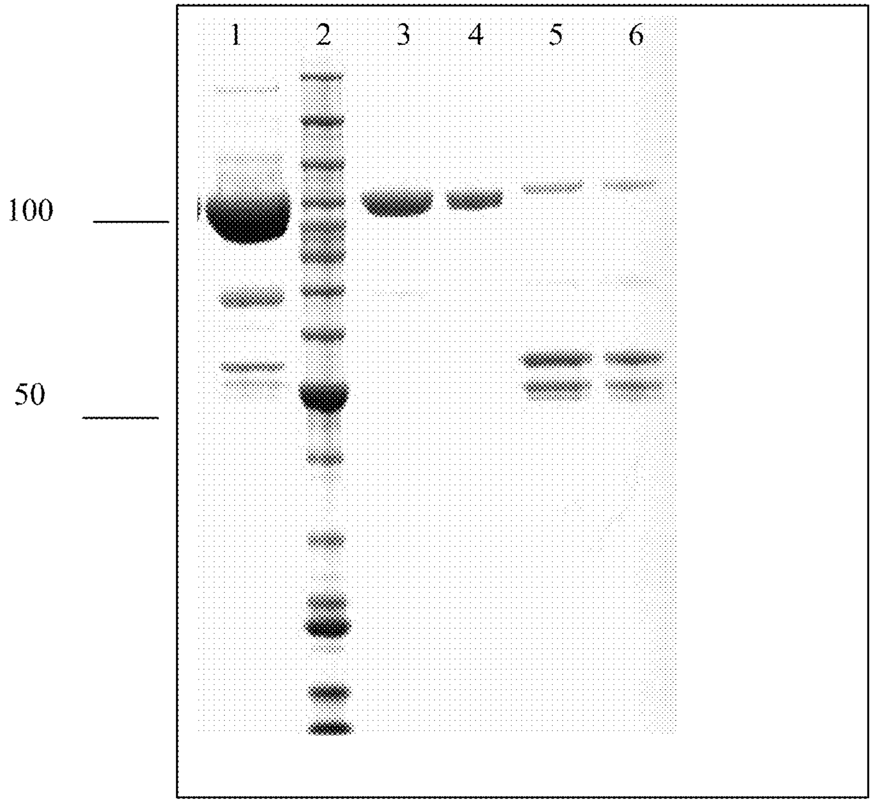

FIG. 2—Purification of $LH_N$/A-CT-SST14 Fusion Protein

Using the methodology outlined in Example 6, an $LH_N$/A-CT-SST14 fusion protein was purified from *E. coli* BL21 (DE3) cells. Briefly, the soluble products obtained following cell disruption were applied to a nickel-charged affinity capture column. Bound proteins were eluted with 200 mM imidazole, treated with Factor Xa to activate the fusion protein and then re-applied to a second nickel-charged affinity capture column. Samples from the purification procedure were assessed by SDS-PAGE. Lane 1: First nickel chelating Sepharose column eluant, Lane 2: Molecular mass markers (kDa), Lanes 3-4: Second nickel chelating Sepharose column eluant under non-reducing conditions, Lanes 5-6: Second nickel chelating Sepharose column eluant under reducing conditions.

FIG. 3—Activity of SST-$LH_N$/A in Cultured Endocrine Cells (AtT20)

Figure 3A:
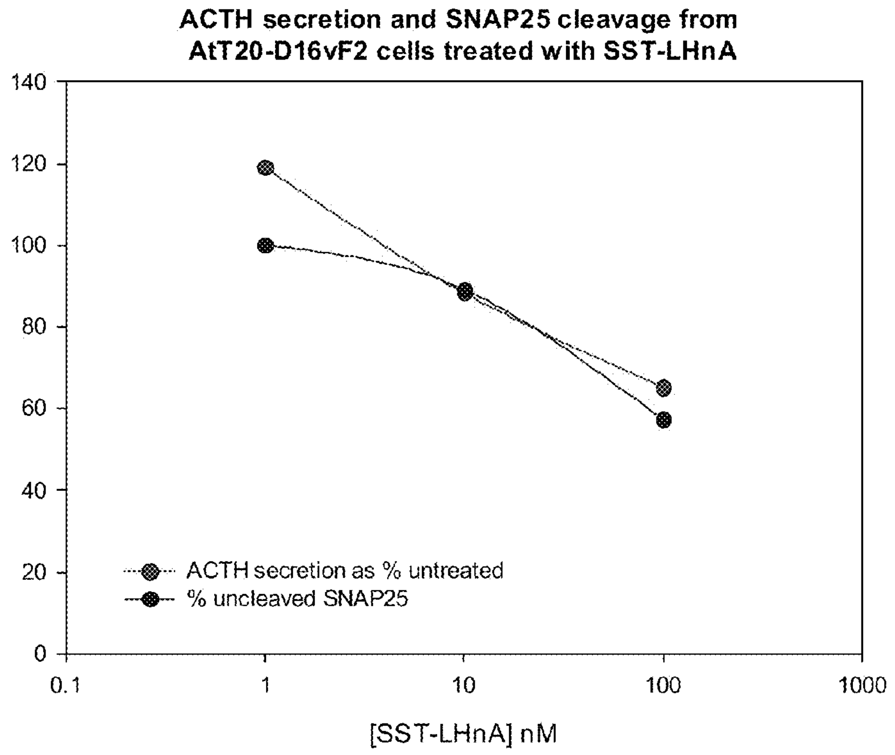
Figure 3B:
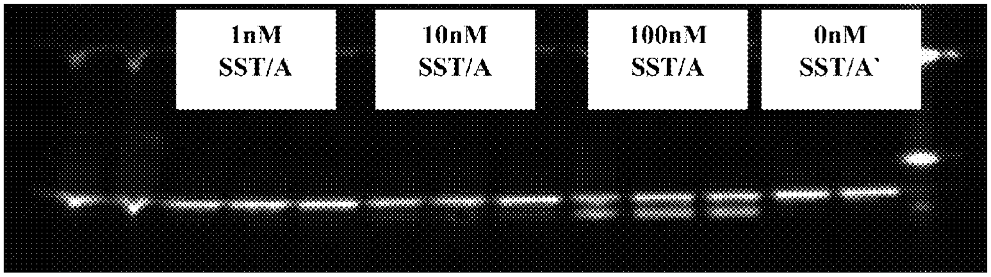

FIG. 3*a* shows Inhibition of secretion of ACTH by SST-$LH_N$/A, and FIG. 3*b* shows corresponding cleavage of SNAP-25 by SST-$LH_N$/A.

Figure 4:
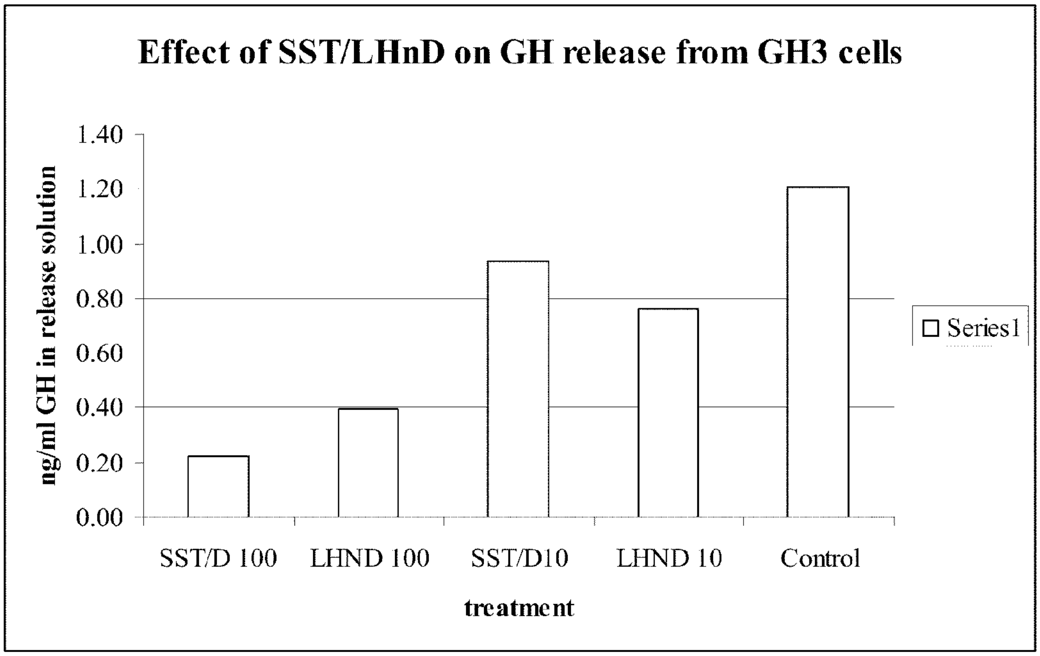

FIG. 4—Activity of SST-$LH_N$/D in Cultured Endocrine Cells (GH3)

FIG. 4 shows the effect of growth hormone release from GH3 cells. Higher administration dosages of SST-$LH_N$/D result in a greater inhibition of growth hormone release.

Figure 5:
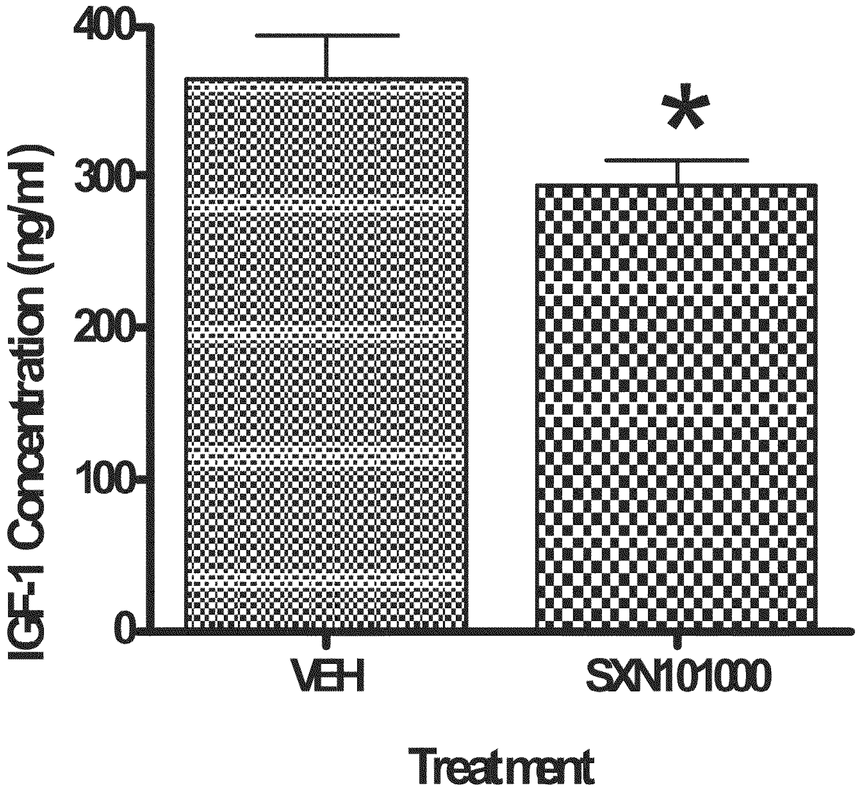

FIG. 5—Activity of CP-GHRH-LHD on Rat IGF-1 Levels in vivo

FIG. 5 shows the effects of i.v. administration of CP-GHRH-LHD (SXN101000) on rat IGF-1 levels 5 days after treatment compared to a vehical only control.

Figure 6:
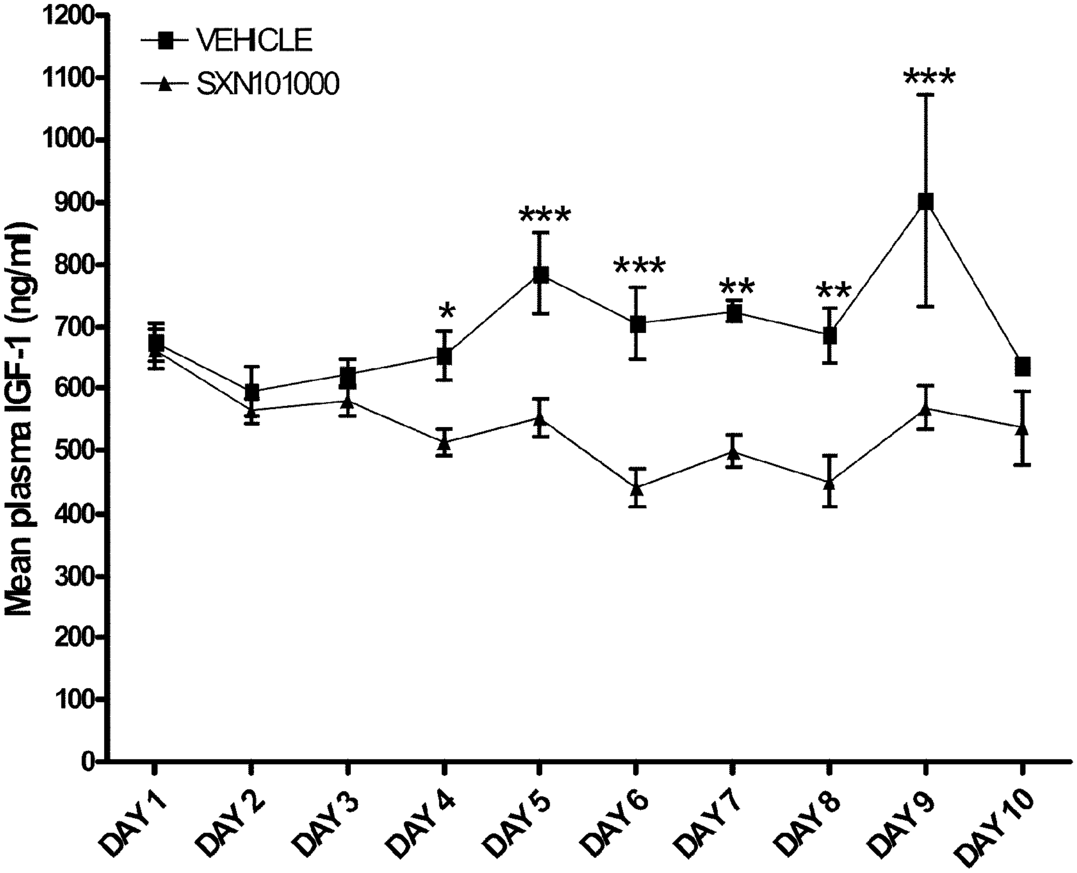

FIG. 6—Activity of CP-GHRH-LHD on Rat IGF-1 Levels in vivo

FIG. 6 shows the effects of i.v. administration of CP-GHRH-LHD (SXN101000) on rat IGF-1 levels on day 1 to 8 days after treatment compared to a vehical only control. Due to the blocking of the cannula on days 9 and 10 have too few an n number to be considered.

FIG. 7—Activity of CP-GHRH-LHD on Rat Growth Hormone Levels in vivo

Figure 7A:
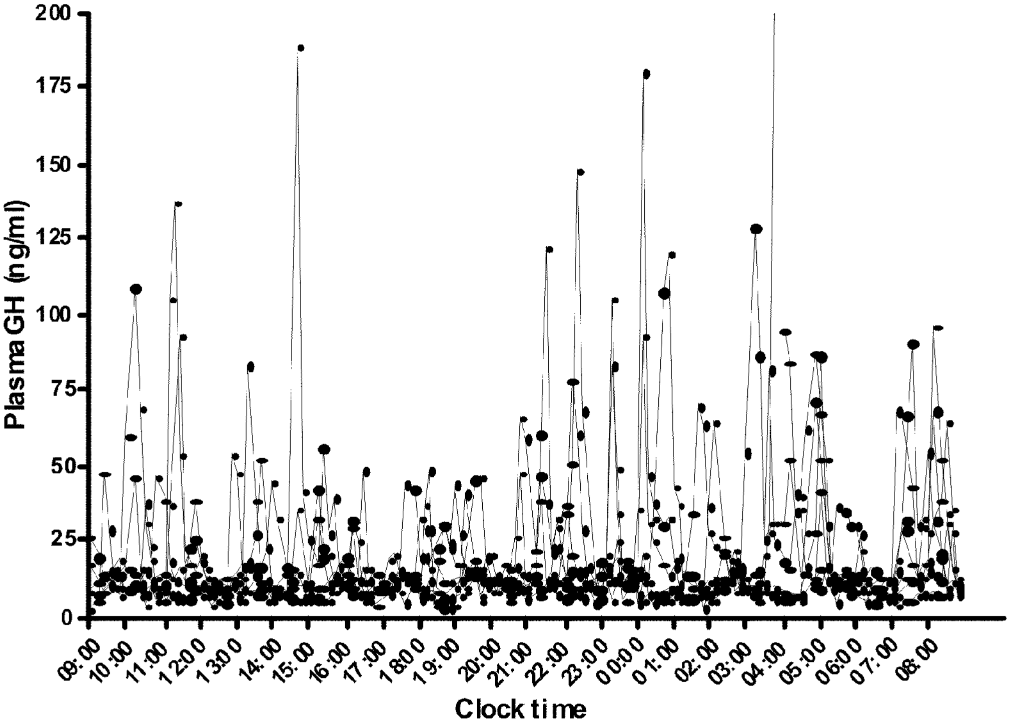
Figure 7B:
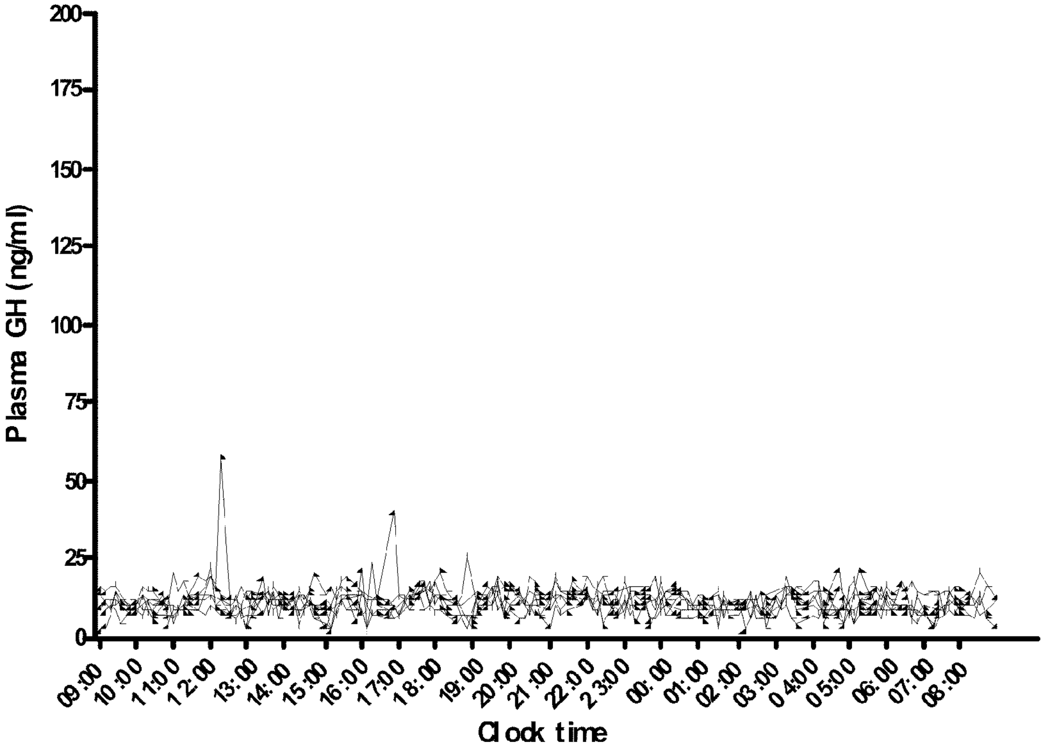
Figure 7C:
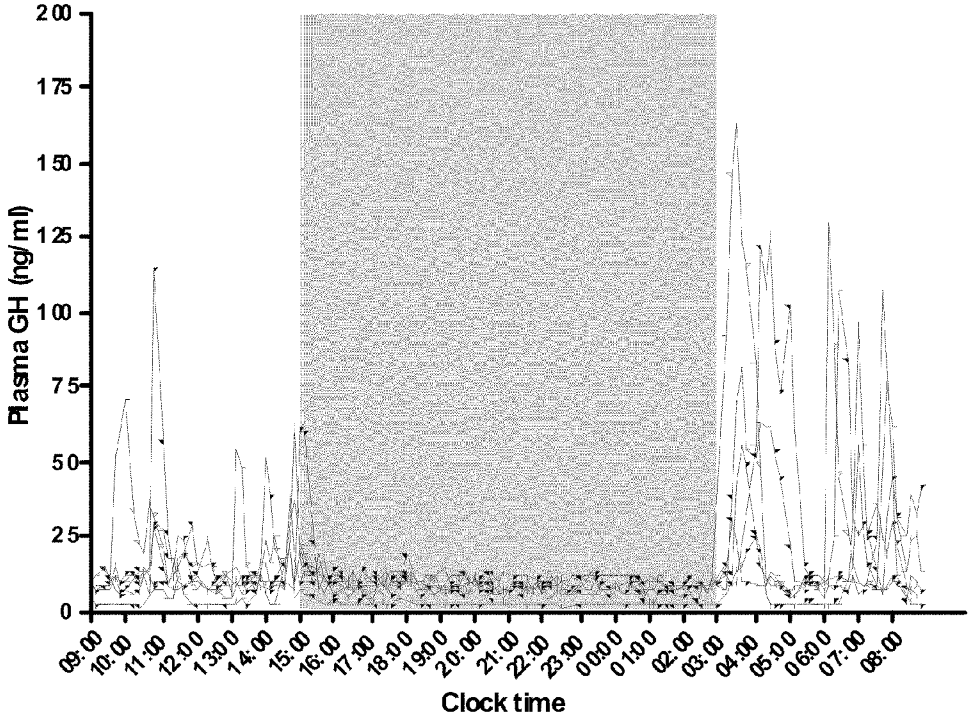

FIG. 7*b* shows the effects of i.v. administration of CP-GHRH-LHD (SXN101000) on rat growth hormone levels on day 5 days after treatment compared to a vehical only control (FIG. 7*a*) and octreotide infusion (FIG. 7*c*).

SEQ ID NOS

1. DNA sequence of $LH_N$/A
2. DNA sequence of $LH_N$/B
3. DNA sequence of $LH_N$/C
4. DNA sequence of $LH_N$/D
5. DNA sequence of the human CP-EN-GS15-SST28 linker
6. DNA sequence of the human CT-GS20-CST28 linker
7. Protein sequence of the CP-CST14-GS20-LHD fusion
8. Protein sequence of the CP-CST14-GS30-LHD fusion
9. Protein sequence of the CP-CST28-GS20-LHD fusion
10. Protein sequence of the CP-CST28-GS30-LHD fusion
11. Protein sequence of the CP-SST14-GS20-LHD fusion
12. Protein sequence of the CP-SST14-GS30-LHD fusion
13. Protein sequence of the CP-SST28-GS20-LHD fusion
14. Protein sequence of the CP-SST28-GS30-LHD fusion
15. Protein sequence of the CT-CST14-GS20-LHD fusion
16. Protein sequence of the CT-CST14-GS30-LHD fusion
17. DNA sequence of the CT-CST28-GS20-LHD fusion
18. Protein sequence of the CT-CST28-GS20-LHD fusion
19. Protein sequence of the CT-CST28-GS30-LHD fusion
20. Protein sequence of the CT-SST14-GS15-L(#Fxa)HD fusion
21. Protein sequence of the CT-SST14-GS30-LHD fusion
22. Protein sequence of the CT-SST28-GS20-LHD fusion
23. Protein sequence of the CT-SST28-GS30-LHD fusion
24. Protein sequence of the CT-SST14-GS35-LHC fusion
25. DNA sequence of the CP-GS15-SST28-LHA fusion
26. Protein sequence of the CP-GS15-SST28-LHA fusion
27. Protein sequence of the CT-SST28-GS15-LHB fusion
28. Protein sequence of the CT-CST14-GS20-LHC fusion
29. Protein sequence of the CT-CST17-GS25-LHC fusion
30. Protein sequence of the CT-CST29-GS15-LHA fusion
31. Protein sequence of the CT-CST29-GS30-LHB fusion
32. DNA sequence of IgA-$H_N$tet
33. Protein sequence of the CT-GHRP-LHC fusion
34. Protein sequence of the CT-GHRH-LHD fusion
35. Protein sequence of the CT-GHRP-LHD fusion
36. Protein sequence of the CT-ghrelin-LHA fusion
37. Protein sequence of the IgA-$H_N$tet-CT-SST14 Fusion
38. Protein sequence of the IgA-$H_N$tet-CT-GHRP Fusion
39. Protein sequence of the CT-ghrelin S3W-LHA fusion
40. Protein sequence of the CT-GRP-LHD fusion
41. Protein sequence of the CT-GRP-LHB fusion
42. Protein sequence of the CP-qGHRH29-LHD fusion
43. Protein sequence of the CP-qGHRH-LHA fusion
44. Protein sequence of the CP-qGHRH-LHC fusion
45. Protein sequence of the CP-qGHRH-LHD fusion
46. Protein sequence of the CP-qGHRH-LHD N10-PL5 fusion
47. Protein sequence of the CP-qGHRH-LHD N10-HX12 fusion
48. Protein sequence of the CP-UTS-LHA fusion
49. Protein sequence of $LH_N$/A
50. Protein sequence of $LH_N$/B
51. Protein sequence of $LH_N$/C
52. Protein sequence of $LH_N$/D
53. Protein sequence of IgA-$H_N$tet
54. Synthesised Octreotide peptide
55. Synthesised GHRH agonist peptide
56. Synthesised GHRH antagonist peptide
57. Protein sequence of the CP-MCH-LHD fusion
58. Protein sequence of the CT-KISS-LHD fusion
59. Protein sequence of the CT-PrRP-LHA fusion
60. Protein sequence of the CP-HS_GHRH_1-27-LHD fusion
61. Protein sequence of the CP-HS_GHRH_1-28-LHD fusion
62. Protein sequence of the CP-HS_GHRH_1-29-LHD fusion
63. Protein sequence of the CP-HS_GHRH_1-44-LHD fusion
64. Protein sequence of the CP-HS_GHRH_1-40-LHD fusion
65. Protein sequence of the CP-HS_GHRH_Ala9-LHD fusion
66. Protein sequence of the CP-HS_GHRH_Ala22-LHD fusion
67. Protein sequence of the CP-HS_GHRH_Ala8_Lys11_1-29-LHD fusion
68. Protein sequence of the CP-HS_GHRH_Ala8_Lys11_Arg12_1-29-LHD fusion
69. Protein sequence of the CP-HS_GHRH_Ala8_Asn11_1-29-LHD fusion
70. Protein sequence of the CP-HS_GHRH_Ala8_Lys20_1-29-LHD fusion
71. Protein sequence of the CP-HS_GHRH_Ala8Lys11_Lys20_1-29-LHD fusion
72. Protein sequence of the CP-HS_GHRH_Ala8_Asn20_1-29-LHD fusion
73. Protein sequence of the CP-HS_GHRH_Ala8_Asn12_1-29-LHD fusion
74. Protein sequence of the CP-HS_GHRH_Ala8_Asn21_1-29-LHD fusion
75. Protein sequence of the CP-HS_GHRH_Ala8_Glu_7_1-29-LHD fusion
76. Protein sequence of the CP-HS_GHRH_Ala8_Glu_10_1-29LHD fusion
77. Protein sequence of the CP-HS_GHRH_Ala8_Glu_13_1-29-LHD fusion
78. Protein sequence of the CP-HS_GHRH_Ala8-LHD fusion
79. Protein sequence of the CP-HS_GHRH_Glu8_1-29-LHD fusion
80. Protein sequence of the CP-HS_GHRH_Ala15_1-27-LHD fusion
81. Protein sequence of the CP-HS_GHRH_Ala15-LHD fusion
82. Protein sequence of the CP-HS_GHRH_Ala8_Ala15_1-29-LHD fusion 83. Protein sequence of the CP-HS_GHRH_Ala8__9__15__22__27-LHD fusion
84. Protein sequence of the CP-HS_GHRH_Ala8__9__15__22-LHD fusion
85. Protein sequence of the CP-HS_GHRH_HVQAL__1-32-LHD fusion
86. Protein sequence of the CP-HS_GHRH_HVSAL__1-29-LHD fusion
87. Protein sequence of the CP-HS_GHRH_HVTAL__1-29-LHD fusion
88. Protein sequence of the CP-HS_GHRH_QALN-LHD fusion
89. Protein sequence of the CP-HS_GHRH_QAL-LHD fusion
90. Protein sequence of the CP-hGHRH29 N8A M27L-LHD fusion
91. Protein sequence of the CP-hGHRH29 N8A K12N M27L-LHD fusion
92. Protein sequence of the N-terminal-hGHRH29 N8A M27L-LHD fusion
93. Protein sequence of the human GnRH-C fusion
94. Protein sequence of the human GnRH-D GS 20 fusion
95. Protein sequence LHD CP Human GHRH 1-40 fusion
96. Protein sequence LHD CP Human GHRH 1-44 fusion
97. Protein sequence LHD CP Human GHRH 1-29 Arg substituted at position 9 fusion
98. Protein sequence LHD CP Human GHRH1-29 Ala substituted at position 8, Arg substituted at position 9 fusion
99. Protein sequence LHD CP Human GHRH1-40 Arg substituted at position 9 fusion
100. Protein sequence LHD CP Human GHRH1-44 Arg substituted at position 9 fusion
101. Protein sequence LHD CP Human GHRH1-29 Arg substituted at position 14, 15, 16 and 17 fusion
102. Protein sequence LHD CP Human GHRH1-40 Ala substituted at position 8 fusion
103. Protein sequence LHC CP Human GHRH 1-40 fusion
104. Protein sequence LHC CP Human GHRH 1-44 fusion
105. Protein sequence LHC CP Human GHRH 1-29 Arg substituted at position 9 fusion
106. Protein sequence LHC CP Human GHRH1-29 Ala substituted at position 8, Arg substituted at position 9 fusion
107. Protein sequence LHC CP Human GHRH1-40 Arg substituted at position 9 fusion
108. Protein sequence LHC CP Human GHRH1-44 Arg substituted at position 9 fusion
109. Protein sequence LHC CP Human GHRH1-29 Arg substituted at position 14, 15, 16 and 17 fusion
110. Protein sequence LHC CP Human GHRH1-40 Ala substituted at position 8 fusion
111. Protein sequence of LHD CP qGHRH fusion
112. DNA sequence of the LHD CP qGHRH fusion

SUMMARY OF EXAMPLES

Example 1 Preparation of a LHA Backbone Construct

Example 2 Construction of LHA-CP-SST28

Example 3 Expression and Purification of a LHA-CP-SST28 Fusion Protein

Example 4 Construction of LHD-CT-CST28

Example 5 Expression and Purification of a LHD-CT-CST28 Fusion Protein

Example 6 Chemical Conjugation of $LH_N/A$ to SST TM

Example 7 Activity of SST-LHA in Cultured Endocrine Cells (AtT20)

Example 8 Activity of SST-LHD in Cultured Neuroendocrine Cells (GH3)

Example 9 Method for Alleviating Acromegalic Symptoms by Reducing Elevated GH and IGF-1 Levels Resulting from Pituitary Adenoma Example 10 Method for Normalising Swollen Hirsute Fingers by Reducing Elevated GH and IGF-1 Levels Resulting from Pituitary Adenoma Example 11 Method for Ameliorating the Consequences of Re-Emerging Growth-Hormone-Secreting Pituitary Adenoma Example 12 Method for Treating Acromegalic Patients Resistant to Somatostatin Analogues Example 13 Method for Treating Cushing's Disease in Patients Intolerant of Somatostatin Analogues Example 14 Method for Reversing Female Sexual Impotence by Treating Prolactinoma Example 15 Method for Bringing about Weight Loss by Treating Insulinoma Example 16 Method for Treating Glucagonoma Example 17 Method for Treating Diarrhoea and Flushing Caused by VIPoma Example 18 Method for Treating Gastrinoma Example 19 Method for Treating Thyrotoxicosis Caused by Thyrotrophinoma Example 20 Method for Treating Recurrent Soft Tissue Swelling Caused by Acromegaly Example 21 Method for Treating Excessive Facial Hirsutism Caused by Cushing's Disease Example 22 Method for Treating Male Galactorrhoea Caused by Prolactinoma Example 23 Method for Treating Multiple Symptoms Caused by Insulinoma Example 24 Method for Treating Acromegalic Patients Resistant to Somatostatin Analogues Example 25 Method for Treating Cushing's Disease in Patients Intolerant of Somatostatin Analogues Example 26 Method for Reversing Female Sexual Impotence by Treating Prolactinoma Example 27 Method for Treating Cushing's Disease Example 28 Method for Treating Gastrinoma Example 29 Method for Alleviating Acromegalic Symptoms by Reducing Elevated GH and IGF-1 Levels Resulting from Pituitary Adenoma Example 30 Method for Treating Acromegalic Patients Resistant to Somatostatin Analogues Example 31 Method for Treating Acromegaly Example 32 Activity of CP-GHRH-LHD on Rat IGF-1 Levels in vivo Example 33 Activity of CP-GHRH-LHD on Rat IGF-1 Levels in vivo Example 34 Activity of CP-GHRH-LHD on Rat Growth Hormone Levels in vivo Example 35 Method for Alleviating Acromegalic Symptoms by Reducing Elevated GH and IGF-1 Levels Resulting from Pituitary Adenoma Example 36 Method for Treating Acromegaly SEQ IDs 1. DNA sequence of $LH_N$/A ggatccATGGAGTTCGTTAACAAACAGTTCAACTATAAAGACCCAGTTAACGGTGTTGACATTGCTTACAT

CAAAATCCCGAACGCTGGCCAGATGCAGCCGGTAAAGGCATTCAAAATCCACAACAAAATCTGGGTTATCC

CGGAACGTGATACCTTTACTAACCCGGAAGAAGGTGACCTGAACCCGCCACCGGAAGCGAAACAGGTGCCG

GTATCTTACTATGACTCCACCTACCTGTCTACCGATAACGAAAAGGACAACTACCTGAAAGGTGTTACTAA

ACTGTTCGAGCGTATTTACTCCACCGACCTGGGCCGTATGCTGCTGACTAGCATCGTTCGCGGTATCCCGT

TCTGGGGCGGTTCTACCATCGATACCGAACTGAAAGTAATCGACACTAACTGCATCAACGTTATTCAGCCG

GACGGTTCCTATCGTTCCGAAGAACTGAACCTGGTGATCATCGGCCCGTCTGCTGATATCATCCAGTTCGA

GTGTCTGAGCTTTGGTCACGAAGTTCTGAACCTCACCCGTAACGGCTACGGTTCCACTCAGTACATCCGTT

TCTCTCCGGACTTCACCTTCGGTTTTGAAGAATCCCTGGAAGTAGACACGAACCCACTGCTGGGCGCTGGT

AAATTCGCAACTGATCCTGCGGTTACCCTGGCTCACGAACTGATTCATGCAGGCCACCGCCTGTACGGTAT

CGCCATCAATCCGAACCGTGTCTTCAAAGTTAACACCAACGCGTATTACGAGATGTCCGGTCTGGAAGTTA

GCTTCGAAGAACTGCGTACTTTTGGCGGTCACGACGCTAAATTCATCGACTCTCTGCAAGAAAACGAGTTC

CGTCTGTACTACTATAACAAGTTCAAAGATATCGCATCCACCCTGAACAAAGCGAAATCCATCGTGGGTAC

CACTGCTTCTCTCCAGTACATGAAGAACGTTTTTAAAGAAAAATACCTGCTCAGCGAAGACACCTCCGGCA

AATTCTCTGTAGACAAGTTGAAATTCGATAAACTTTACAAAATGCTGACTGAAATTTACACCGAAGACAAC

TTCGTTAAGTTCTTTAAAGTTCTGAACCGCAAAACCTATCTGAACTTCGACAAGGCAGTATTCAAAATCAA

CATCGTGCCGAAAGTTAACTACACTATCTACGATGGTTTCAACCTGCGTAACACCAACCTGGCTGCTAATT

TTAACGGCCAGAACACGGAAATCAACAACATGAACTTCACAAAACTGAAAAACTTCACTGGTCTGTTCGAG

TTTTACAAGCTGCTGTGCGTCGACGGCATCATTACCTCCAAAACTAAATCTGACGATGACGATAAAAACAA

AGCGCTGAACCTGCAGTGTATCAAGGTTAACAACTGGGATTTATTCTTCAGCCCGAGTGAAGACAACTTCA

CCAACGACCTGAACAAAGGTGAAGAAATCACCTCAGATACTAACATCGAAGCAGCCGAAGAAAACATCTCG

CTGGACCTGATCCAGCAGTACTACCTGACCTTTAATTTCGACAACGAGCCGGAAAACATTTCTATCGAAAA

CCTGAGCTCTGATATCATCGGCCAGCTGGAACTGATGCCGAACATCGAACGTTTCCCAAACGGTAAAAAGT

ACGAGCTGGACAAATATACCATGTTCCACTACCTGCGCGCGCAGGAATTTGAACACGGCAAATCCCGTATC

GCACTGACTAACTCCGTTAACGAAGCTCTGCTCAACCCGTCCCGTGTATACACCTTCTTCTCTAGCGACTA

CGTGAAAAAGGTCAACAAAGCGACTGAAGCTGCAATGTTCTTGGGTTGGGTTGAACAGCTTGTTTATGATT

TTACCGACGAGACGTCCGAAGTATCTACTACCGACAAAATTGCGGATATCACTATCATCATCCCGTACATC

GGTCCGGCTCTGAACATTGGCAACATGCTGTACAAAGACGACTTCGTTGGCGCACTGATCTTCTCCGGTGC

GGTGATCCTGCTGGAGTTCATCCCGGAAATCGCCATCCCGGTACTGGGCACCTTTGCTCTGGTTTCTTACA

TTGCAAACAAGGTTCTGACTGTACAAACCATCGACAACGCGCTGAGCAAACGTAACGAAAAATGGGATGAA

GTTTACAAATATATCGTGACCAACTGGCTGGCTAAGGTTAATACTCAGATCGACCTCATCCGCAAAAAAAT

GAAAGAAGCACTGGAAAACCAGGCGGAAGCTACCAAGGCAATCATTAACTACCAGTACAACCAGTACACCG

AGGAAGAAAAAAACAACATCAACTTCAACATCGACGATCTGTCCTCTAAACTGAACGAATCCATCAACAAA

GCTATGATCAACATCAACAAGTTCCTGAACCAGTGCTCTGTAAGCTATCTGATGAACTCCATGATCCCGTA

CGGTGTTAAACGTCTGGAGGACTTCGATGCGTCTCTGAAAGACGCCCTGCTGAAATACATTTACGACAACC

GTGGCACTCTGATCGGTCAGGTTGATCGTCTGAAGGACAAAGTGAACAATACCTTATCGACCGACATCCCT

TTTCAGCTCAGTAAATATGTCGATAACCAACGCCTTTTGTCCACTtaataagctt

2. DNA sequence of $LH_N$/B

GGATCCATGCCGGTTACCATCAACAACTTCAACTACAACGACCCGATCGACAACAACAACATCATTATGAT

GGAACCGCCGTTCGCACGTGGTACCGGACGTTACTACAAGGCTTTTAAGATCACCGACCGTATCTGGATCA

| SEQ IDs |
|---|
| TCCCGGAACGTTACACCTTCGGTTACAAACCTGAGGACTTCAACAAGAGTAGCGGGATTTTCAATCGTGAC |
| GTCTGCGAGTACTATGATCCAGATTATCTGAATACCAACGATAAGAAGAACATATTCCTTCAGACTATGAT |
| TAAACTCTTCAACCGTATCAAAAGCAAACCGCTCGGTGAAAAACTCCTCGAAATGATTATCAACGGTATCC |
| CGTACCTCGGTGACCGTCGTGTCCCGCTTGAAGAGTTCAACACCAACATCGCAAGCGTCACCGTCAACAAA |
| CTCATCAGCAACCCAGGTGAAGTCGAACGTAAAAAAGGTATCTTCGCAAACCTCATCATCTTCGGTCCGGG |
| TCCGGTCCTCAACGAAAACGAAACCATCGACATCGGTATCCAGAACCACTTCGCAAGCCGTGAAGGTTTCG |
| GTGGTATCATGCAGATGAAATTCTGCCCGGAATACGTCAGTGTCTTCAACAACGTCCAGGAAAACAAAGGT |
| GCAAGCATCTTCAACCGTCGTGGTTACTTCAGCGACCCGGCACTCATCCTCATGCATGAACTCATCCACGT |
| CCTCCACGGTCTCTACGGTATCAAAGTTGACGACCTCCCGATCGTCCCGAACGAGAAGAAATTCTTCATGC |
| AGAGCACCGACGCAATCCAGGCTGAGGAACTCTACACCTTCGGTGGCCAAGACCCAAGTATCATAACCCCG |
| TCCACCGACAAAAGCATCTACGACAAAGTCCTCCAGAACTTCAGGGGTATCGTGGACAGACTCAACAAAGT |
| CCTCGTCTGCATCAGCGACCCGAACATCAATATCAACATATACAAGAACAAGTTCAAAGACAAGTACAAAT |
| TCGTCGAGGACAGCGAAGGCAAATACAGCATCGACGTAGAAAGTTTCGACAAGCTCTACAAAAGCCTCATG |
| TTCGGTTTCACCGAAACCAACATCGCCGAGAACTACAAGATCAAGACAAGGGCAAGTTACTTCAGCGACAG |
| CCTCCCGCCTGTCAAAATCAAGAACCTCTTAGACAACGAGATTTACACAATTGAAGAGGGCTTCAACATCA |
| GTGACAAAGACATGGAGAAGGAATACAGAGGTCAGAACAAGGCTATCAACAAACAGGCATACGAGGAGATC |
| AGCAAAGAACACCTCGCAGTCTACAAGATCCAGATGTGCGTCGACGGCATCATTACCTCCAAAACTAAATC |
| TGACGATGACGATAAAAACAAAGCGCTGAACCTGCAGTGCATCGACGTTGACAACGAAGACCTGTTCTTCA |
| TCGCTGACAAAAACAGCTTCAGTGACGACCTGAGCAAAAACGAACGTATCGAATACAACACCCAGAGCAAC |
| TACATCGAAAACGACTTCCCGATCAACGAACTGATCCTGGACACCGACCTGATAAGTAAAATCGAACTGCC |
| GAGCGAAAACACCGAAAGTCTGACCGACTTCAACGTTGACGTTCCGGTTTACGAAAAACAGCCGGCTATCA |
| AGAAAATCTTCACCGACGAAAACACCATCTTCCAGTACCTGTACAGCCAGACCTTCCCGCTGGACATCCGT |
| GACATCAGTCTGACCAGCAGTTTCGACGACGCTCTGCTGTTCAGCAACAAAGTTTACAGTTTCTTCAGCAT |
| GGACTACATCAAAACCGCTAACAAAGTTGTTGAAGCAGGGCTGTTCGCTGGTTGGGTTAAACAGATCGTTA |
| ACGACTTCGTTATCGAAGCTAACAAAAGCAACACTATGGACAAAATCGCTGACATCAGTCTGATCGTTCCG |
| TACATCGGTCTGGCTCTGAACGTTGGTAACGAAACCGCTAAAGGTAACTTTGAAAACGCTTTCGAGATCGC |
| TGGTGCAAGCATCCTGCTGGAGTTCATCCCGGAACTGCTGATCCCGGTTGTTGGTGCTTTCCTGCTGGAAA |
| GTTACATCGACAACAAAAACAAGATCATCAAAACCATCGACAACGCTCTGACCAAACGTAACGAAAAATGG |
| AGTGATATGTACGGTCTGATCGTTGCTCAGTGGCTGAGCACCGTCAACACCCAGTTCTACACCATCAAAGA |
| AGGTATGTACAAAGCTCTGAACTACCAGGCTCAGGCTCTGGAAGAGATCATCAAATACCGTTACAACATCT |
| ACAGTGAGAAGGAAAAGAGTAACATCAACATCGACTTCAACGACATCAACAGCAAACTGAACGAAGGTATC |
| AACCAGGCTATCGACAACATCAACAACTTCATCAACGGTTGCAGTGTTAGCTACCTGATGAAGAAGATGAT |
| CCCGCTGGCTGTTGAAAAACTGCTGGACTTCGACAACACCCTGAAAAAGAACCTGCTGAACTACATCGACG |
| AAAACAAGCTGTACCTGATCGGTAGTGCTGAATACGAAAAAAGTAAAGTGAACAAATACCTGAAGACCATC |
| ATGCCGTTCGACCTGAGTATCTACACCAACGACACCATCCTGATCGAAATGTTCAACAAATACAACTCTta |
| ataagctt |

3. DNA sequence of LH$_N$/C
ggatccATGCCGATCACCATCAACAACTTCAACTACAGCGATCCGGTGGATAACAAAAACATCCTGTACCT

GGATACCCATCTGAATACCCTGGCGAACGAACCGGAAAAAGCGTTTCGTATCACCGGCAACATTTGGGTTA

-continued

SEQ IDs

TTCCGGATCGTTTTAGCCGTAACAGCAACCCGAATCTGAATAAACCGCCGCGTGTTACCAGCCCGAAAAGC

GGTTATTACGATCCGAACTATCTGAGCACCGATAGCGATAAAGATACCTTCCTGAAAGAAATCATCAAACT

GTTCAAACGCATCAACAGCCGTGAAATTGGCGAAGAACTGATCTATCGCCTGAGCACCGATATTCCGTTTC

CGGGCAACAACAACACCCCGATCAACACCTTTGATTTCGATGTGGATTTCAACAGCGTTGATGTTAAAACC

CGCCAGGGTAACAATTGGGTGAAAACCGGCAGCATTAACCCGAGCGTGATTATTACCGGTCCGCGCGAAAA

CATTATTGATCCGGAAACCAGCACCTTTAAACTGACCAACAACACCTTTGCGGCGCAGGAAGGTTTTGGCG

CGCTGAGCATTATTAGCATTAGCCCGCGCTTTATGCTGACCTATAGCAACGCGACCAACGATGTTGGTGAA

GGCCGTTTCAGCAAAAGCGAATTTTGCATGGACCCGATCCTGATCCTGATGCATGAACTGAACCATGCGAT

GCATAACCTGTATGGCATCGCGATTCCGAACGATCAGACCATTAGCAGCGTGACCAGCAACATCTTTTACA

GCCAGTACAACGTGAAACTGGAATATGCGGAAATCTATGCGTTTGGCGGTCCGACCATTGATCTGATTCCG

AAAAGCGCGCGCAAATACTTCGAAGAAAAAGCGCTGGATTACTATCGCAGCATTGCGAAACGTCTGAACAG

CATTACCACCGCGAATCCGAGCAGCTTCAACAAATATATCGGCGAATATAAACAGAAACTGATCCGCAAAT

ATCGCTTTGTGGTGGAAAGCAGCGGCGAAGTTACCGTTAACCGCAATAAATTCGTGGAACTGTACAACGAA

CTGACCCAGATCTTCACCGAATTTAACTATGCGAAAATCTATAACGTGCAGAACCGTAAAATCTACCTGAG

CAACGTGTATACCCCGGTGACCGCGAATATTCTGGATGATAACGTGTACGATATCCAGAACGGCTTTAACA

TCCCGAAAAGCAACCTGAACGTTCTGTTTATGGGCCAGAACCTGAGCCGTAATCCGGCGCTGCGTAAAGTG

AACCCGGAAAACATGCTGTACCTGTTCACCAAATTTTGCGTCGACGCGATTGATGGTCGTAGCCTGTACAA

CAAAACCCTGCAGTGTCGTGAACTGCTGGTGAAAAACACCGATCTGCCGTTTATTGGCGATATCAGCGATG

TGAAAACCGATATCTTCCTGCGCAAAGATATCAACGAAGAAACCGAAGTGATCTACTACCCGGATAACGTG

AGCGTTGATCAGGTGATCCTGAGCAAAAACACCAGCGAACATGGTCAGCTGGATCTGCTGTATCCGAGCAT

TGATAGCGAAAGCGAAATTCTGCCGGGCGAAAACCAGGTGTTTTACGATAACCGTACCCAGAACGTGGATT

ACCTGAACAGCTATTACTACCTGGAAAGCCAGAAACTGAGCGATAACGTGGAAGATTTTACCTTTACCCGC

AGCATTGAAGAAGCGCTGGATAACAGCGCGAAAGTTTACACCTATTTTCCGACCCTGGCGAACAAAGTTAA

TGCGGGTGTTCAGGGCGGTCTGTTTCTGATGTGGGCGAACGATGTGGTGGAAGATTTCACCACCAACATCC

TGCGTAAAGATACCCTGGATAAAATCAGCGATGTTAGCGCGATTATTCCGTATATTGGTCCGGCGCTGAAC

ATTAGCAATAGCGTGCGTCGTGGCAATTTTACCGAAGCGTTTGCGGTTACCGGTGTGACCATTCTGCTGGA

AGCGTTTCCGGAATTTACCATTCCGGCGCTGGGTGCGTTTGTGATCTATAGCAAAGTGCAGGAACGCAACG

AAATCATCAAAACCATCGATAACTGCCTGGAACAGCGTATTAAACGCTGGAAAGATAGCTATGAATGGATG

ATGGGCACCTGGCTGAGCCGTATTATCACCCAGTTCAACAACATCAGCTACCAGATGTACGATAGCCTGAA

CTATCAGGCGGGTGCGATTAAAGCGAAAATCGATCTGGAATACAAAAAATACAGCGGCAGCGATAAAGAAA

ACATCAAAAGCCAGGTTGAAAACCTGAAAAACAGCCTGGATGTGAAAATTAGCGAAGCGATGAATAACATC

AACAAATTCATCCGCGAATGCAGCGTGACCTACCTGTTCAAAAACATGCTGCCGAAAGTGATCGATGAACT

GAACGAATTTGATCGCAACACCAAAGCGAAACTGATCAACCTGATCGATAGCCACAACATTATTCTGGTGG

GCGAAGTGGATAAACTGAAAGCGAAAGTTAACAACAGCTTCCAGAACACCATCCCGTTTAACATCTTCAGC

TATACCAACAACAGCCTGCTGAAAGATATCATCAACGAATACTTCAATtaataagctt

4. DNA sequence of $LH_N$/D
ggatccATGACGTGGCCAGTTAAGGATTTCAACTACTCAGATCCTGTAAATGACAACGATATTCTGTACCT

TCGCATTCCACAAAATAAACTGATCACCACACCAGTCAAAGCATTCATGATTACTCAAAACATTTGGGTCA

TTCCAGAACGCTTTTCTAGTGACACAAATCCGAGTTTATCTAAACCTCCGCGTCCGACGTCCAAATATCAG

-continued

SEQ IDs

AGCTATTACGATCCCTCATATCTCAGTACGGACGAACAAAAAGATACTTTCCTTAAAGGTATCATTAAACT

GTTTAAGCGTATTAATGAGCGCGATATCGGGAAAAAGTTGATTAATTATCTTGTTGTGGGTTCCCCGTTCA

TGGGCGATAGCTCTACCCCCGAAGACACTTTTGATTTTACCCGTCATACGACAAACATCGCGGTAGAGAAG

TTTGAGAACGGATCGTGGAAAGTCACAAACATCATTACACCTAGCGTCTTAATTTTTGGTCCGCTGCCAAA

CATCTTAGATTATACAGCCAGCCTGACTTTGCAGGGGCAACAGTCGAATCCGAGTTTCGAAGGTTTTGGTA

CCCTGAGCATTCTGAAAGTTGCCCCGGAATTTCTGCTCACTTTTTCAGATGTCACCAGCAACCAGAGCTCA

GCAGTATTAGGAAAGTCAATTTTTTGCATGGACCCGGTTATTGCACTGATGCACGAACTGACGCACTCTCT

GCATCAACTGTATGGGATCAACATCCCCAGTGACAAACGTATTCGTCCCCAGGTGTCTGAAGGATTTTTCT

CACAGGATGGGCCGAACGTCCAGTTCGAAGAGTTGTATACTTTCGGAGGCCTGGACGTAGAGATCATTCCC

CAGATTGAGCGCAGTCAGCTGCGTGAGAAGGCATTGGGCCATTATAAGGATATTGCAAAACGCCTGAATAA

CATTAACAAAACGATTCCATCTTCGTGGATCTCGAATATTGATAAATATAAGAAAATTTTTAGCGAGAAAT

ATAATTTTGATAAAGATAATACAGGTAACTTTGTGGTTAACATTGACAAATTCAACTCCCTTTACAGTGAT

TTGACGAATGTAATGAGCGAAGTTGTGTATAGTTCCCAATACAACGTTAAGAATCGTACCCATTACTTCTC

TCGTCACTACCTGCCGGTTTTCGCGAACATCCTTGACGATAATATTTACACTATTCGTGACGGCTTTAACT

TGACCAACAAGGGCTTCAATATTGAAAATTCAGGCCAGAACATTGAACGCAACCCGGCCTTGCAGAAACTG

TCGAGTGAATCCGTGGTTGACCTGTTTACCAAAGTCTGCGTCGACAAAAGCGAAGAGAAGCTGTACGATGA

CGATGACAAAGATCGTTGGGGATCGTCCCTGCAGTGTATTAAAGTGAAAAACAATCGGCTGCCTTATGTAG

CAGATAAAGATAGCATTAGTCAGGAGATTTTCGAAAATAAAATTATCACTGACGAAACCAATGTTCAGAAT

TATTCAGATAAATTTTCACTGGACGAAAGCATCTTAGATGGCCAAGTTCCGATTAACCCGGAAATTGTTGA

TCCGTTACTGCCGAACGTGAATATGGAACCGTTAAACCTCCCTGGCGAAGAGATCGTATTTTATGATGACA

TTACGAAATATGTGGACTACCTTAATTCTTATTACTATTTGGAAAGCCAGAAACTGTCCAATAACGTGGAA

AACATTACTCTGACCACAAGCGTGGAAGAGGCTTTAGGCTACTCAAATAAGATTTATACCTTCCTCCCGTC

GCTGGCGGAAAAAGTAAATAAAGGTGTGCAGGCTGGTCTGTTCCTCAACTGGGCGAATGAAGTTGTCGAAG

ACTTTACCACGAATATTATGAAAAAGGATACCCTGGATAAAATCTCCGACGTCTCGGTTATTATCCCATAT

ATTGGCCCTGCGTTAAATATCGGTAATAGTGCGCTGCGGGGGAATTTTAACCAGGCCTTTGCTACCGCGGG

CGTCGCGTTCCTCCTGGAGGGCTTTCCTGAATTTACTATCCCGGCGCTCGGTGTTTTTACATTTTACTCTT

CCATCCAGGAGCGTGAGAAAATTATCAAAACCATCGAAAACTGCCTGGAGCAGCGGGTGAAACGCTGGAAA

GATTCTTATCAATGGATGGTGTCAAACTGGTTATCTCGCATCACGACCCAATTCAACCATATTAATTACCA

GATGTATGATAGTCTGTCGTACCAAGCTGACGCCATTAAAGCCAAAATTGATCTGGAATATAAAAAGTACT

CTGGTAGCGATAAGGAGAACATCAAAAGCCAGGTGGAGAACCTTAAGAATAGTCTGGATGTGAAAATCTCT

GAAGCTATGAATAACATTAACAAATTCATTCGTGAATGTTCGGTGACGTACCTGTTCAAGAATATGCTGCC

AAAAGTTATTGATGAACTGAATAAATTTGATCTGCGTACCAAAACCGAACTTATCAACCTCATCGACTCCC

ACAACATTATCCTTGTGGGCGAAGTGGATCGTCTGAAGGCCAAAGTAAACGAGAGCTTTGAAAATACGATG

CCGTTTAATATTTTTTCATATACCAATAACTCCTTGCTGAAAGATATCATCAATGAATATTTCAATtaata agctt

5. DNA sequence of the human CP-EN-GS15-SST28 linker
CATATGGGATCCGGTTTAAACGTCGACGGCATCATTACCTCCAAAACTAAATCTGACGATGACGATAAAAG

CGCCAATTCAAATCCTGCAATGGCGCCACGCGAACGCAAAGCTGGTTGCAAAAACTTCTTCTGGAAAACCT

TCACCTCTTGCGCGCTAGCGGGCGGTGGCGGTAGCGGCGGTGGCGGTAGCGGCGGTGGCGGTAGCGCACTA

-continued

| SEQ IDs |
|---|

GTGCTGCAGCTAGAATAATGAAAGCTT

6. DNA sequence of the Human CT-GS20-CST28 linker
GGATCCGTCGACCTGCAGGGTCTAGAAGGCGGTGGCGGTAGCGGCGGTGGCGGTAGCGGCGGTGGCGGTAG

CGGCGGTGGCGGTAGCGCACTAGTGCAGGAAAGACCTCCATTACAACAACCTCCACATCGCGATAAGAAAC

CATGTAAGAATTTCTTTTGGAAAACATTTAGCAGTTGCAAATGATAAAAGCTT

7. Protein sequence of the CP-CST14-GS20-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKPCKNFFWKTFSSCKALAGGGGSGGGGSGGGGSALVLQCIKVKNNR

LPYVADKDSISQEIFENKIITDETNVQNYSDKFSLDESILDGQVPINPEIVDPLLPNVNMEPLNLPGEEIV

FYDDITKYVDYLNSYYYLESQKLSNNVENITLTTSVEEALGYSNKIYTFLPSLAEKVNKGVQAGLFLNWAN

EVVEDFTTNIMKKDTLDKISDVSVIIPYIGPALNIGNSALRGNFNQAFATAGVAFLLEGFPEFTIPALGVF

TFYSSIQEREKIIKTIENCLEQRVKRWKDSYQWMVSNWLSRITTQFNHINYQMYDSLSYQADAIKAKIDLE

YKKYSGSDKENIKSQVENLKNSLDVKISEAMNNINKFIRECSVTYLFKNMLPKVIDELNKFDLRTKTELIN

LIDSHNIILVGEVDRLKAKVNESFENTMPFNIFSYTNNSLLKDIINEYFN

8. Protein sequence of the CP-CST14-GS30-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKPCKNFFWKTFSSCKALAGGGGSGGGGSGGGGSGGGGSGGGGSALA

LQCIKVKNNRLPYVADKDSISQEIFENKIITDETNVQNYSDKFSLDESILDGQVPINPEIVDPLLPNVNME

PLNLPGEEIVFYDDITKYVDYLNSYYYLESQKLSNNVENITLTTSVEEALGYSNKIYTFLPSLAEKVNKGV

QAGLFLNWANEVVEDFTTNIMKKDTLDKISDVSVIIPYIGPALNIGNSALRGNFNQAFATAGVAFLLEGFP

EFTIPALGVFTFYSSIQEREKIIKTIENCLEQRVKRWKDSYQWMVSNWLSRITTQFNHINYQMYDSLSYQA

DAIKAKIDLEYKKYSGSDKENIKSQVENLKNSLDVKISEAMNNINKFIRECSVTYLFKNMLPKVIDELNKF

DLRTKTELINLIDSHNIILVGEVDRLKAKVNESFENTMPFNIFSYTNNSLLKDIINEYFN

9. Protein sequence of the CP-CST28-GS20-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

-continued

| SEQ IDs |
|---|
| SVVDLFTKVCVDGIITSKTKSDDDDKQERPPLQQPPHRDKKPCKNFFWKTFSSCKALAGGGGSGGGGSGGG |
| GSALVLQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 10. Protein sequence of the CP-CST28-GS30-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKQERPPLQQPPHRDKKPCKNFFWKTFSSCKALAGGGGSGGGGSGGG |
| GSGGGGSGGGGSALVLQCIKVKNNRLPYVADKDSISQEIFENKIITDETNVQNYSDKFSLDESILDGQVPI |
| NPEIVDPLLPNVNMEPLNLPGEEIVFYDDITKYVDYLNSYYYLESQKLSNNVENITLTTSVEEALGYSNKI |
| YTFLPSLAEKVNKGVQAGLFLNWANEVVEDFTTNIMKKDTLDKISDVSVIIPYIGPALNIGNSALRGNFNQ |
| AFATAGVAFLLEGFPEFTIPALGVFTFYSSIQEREKIIKTIENCLEQRVKRWKDSYQWMVSNWLSRITTQF |
| NHINYQMYDSLSYQADAIKAKIDLEYKKYSGSDKENIKSQVENLKNSLDVKISEAMNNINKFIRECSVTYL |
| FKNMLPKVIDELNKFDLRTKTELINLIDSHNIILVGEVDRLKAKVNESFENTMPFNIFSYTNNSLLKDIIN |
| EYFN |
| 11. Protein sequence of the CP-SST14-GS20-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKAGCKNFFWKTFTSCALAGGGGSGGGGSGGGGSALVLQCIKVKNNR |
| LPYVADKDSISQEIFENKIITDETNVQNYSDKFSLDESILDGQVPINPEIVDPLLPNVNMEPLNLPGEEIV |
| FYDDITKYVDYLNSYYYLESQKLSNNVENITLTTSVEEALGYSNKIYTFLPSLAEKVNKGVQAGLFLNWAN |
| EVVEDFTTNIMKKDTLDKISDVSVIIPYIGPALNIGNSALRGNFNQAFATAGVAFLLEGFPEFTIPALGVF |
| TFYSSIQEREKIIKTIENCLEQRVKRWKDSYQWMVSNWLSRITTQFNHINYQMYDSLSYQADAIKAKIDLE |
| YKKYSGSDKENIKSQVENLKNSLDVKISEAMNNINKFIRECSVTYLFKNMLPKVIDELNKFDLRTKTELIN |
| LIDSHNIILVGEVDRLKAKVNESFENTMPFNIFSYTNNSLLKDIINEYFN |
| 12. Protein sequence of the CP-SST14-GS30-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |

-continued

| SEQ IDs |
|---|
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKAGCKNFFWKTFTSCALAGGGGSGGGGSGGGGSGGGGSGGGGSALA |
| LQCIKVKNNRLPYVADKDSISQEIFENKIITDETNVQNYSDKFSLDESILDGQVPINPEIVDPLLPNVNME |
| PLNLPGEEIVFYDDITKYVDYLNSYYYLESQKLSNNVENITLTTSVEEALGYSNKIYTFLPSLAEKVNKGV |
| QAGLFLNWANEVVEDFTTNIMKKDTLDKISDVSVIIPYIGPALNIGNSALRGNFNQAFATAGVAFLLEGFP |
| EFTIPALGVFTFYSSIQEREKIIKTIENCLEQRVKRWKDSYQWMVSNWLSRITTQFNHINYQMYDSLSYQA |
| DAIKAKIDLEYKKYSGSDKENIKSQVENLKNSLDVKISEAMNNINKFIRECSVTYLFKNMLPKVIDELNKF |
| DLRTKTELINLIDSHNIILVGEVDRLKAKVNESFENTMPFNIFSYTNNSLLKDIINEYFN |
| 13. Protein sequence of the CP-SST28-GS20-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKSANSNPAMAPRERKAGCKNFFWKTFTSCALAGGGGSGGGGSGGGG |
| SALVLQCIKVKNNRLPYVADKDSISQEIFENKIITDETNVQNYSDKFSLDESILDGQVPINPEIVDPLLPN |
| VNMEPLNLPGEEIVFYDDITKYVDYLNSYYYLESQKLSNNVENITLTTSVEEALGYSNKIYTFLPSLAEKV |
| NKGVQAGLFLNWANEVVEDFTTNIMKKDTLDKISDVSVIIPYIGPALNIGNSALRGNFNQAFATAGVAFLL |
| EGFPEFTIPALGVFTFYSSIQEREKIIKTIENCLEQRVKRWKDSYQWMVSNWLSRITTQFNHINYQMYDSL |
| SYQADAIKAKIDLEYKKYSGSDKENIKSQVENLKNSLDVKISEAMNNINKFIRECSVTYLFKNMLPKVIDE |
| LNKFDLRTKTELINLIDSHNIILVGEVDRLKAKVNESFENTMPFNIFSYTNNSLLKDIINEYFN |
| 14. Protein sequence of the CP-SST28-GS30-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKSANSNPAMAPRERKAGCKNFFWKTFTSCALAGGGGSGGGGSGGGG |
| SGGGGSGGGGSALALQCIKVKNNRLPYVADKDSISQEIFENKIITDETNVQNYSDKFSLDESILDGQVPIN |
| PEIVDPLLPNVNMEPLNLPGEEIVFYDDITKYVDYLNSYYYLESQKLSNNVENITLTTSVEEALGYSNKIY |
| TFLPSLAEKVNKGVQAGLFLNWANEVVEDFTTNIMKKDTLDKISDVSVIIPYIGPALNIGNSALRGNFNQA |
| FATAGVAFLLEGFPEFTIPALGVFTFYSSIQEREKIIKTIENCLEQRVKRWKDSYQWMVSNWLSRITTQFN |
| HINYQMYDSLSYQADAIKAKIDLEYKKYSGSDKENIKSQVENLKNSLDVKISEAMNNINKFIRECSVTYLF |
| KNMLPKVIDELNKFDLRTKTELINLIDSHNIILVGEVDRLKAKVNESFENTMPFNIFSYTNNSLLKDIINE |
| YFN |

-continued

| SEQ IDs |
|---|

15. Protein sequence of the CT-CST14-GS20-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVPCKNFFWKTFSSCK

16. Protein sequence of the CT-CST14-GS30-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSGGGGSGGGGSALVPCKNFFWKTFSSCK

17. DNA sequence of the CT-CST28-GS20-LHD fusion
GGATCCATGACGTGGCCAGTTAAGGATTTCAACTACTCAGATCCTGTAAATGACAACGATATTCTGTACCT

TCGCATTCCACAAAATAAACTGATCACCACACCAGTCAAAGCATTCATGATTACTCAAAACATTTGGGTCA

TTCCAGAACGCTTTTCTAGTGACACAAATCCGAGTTTATCTAAACCTCCGCGTCCGACGTCCAAATATCAG

AGCTATTACGATCCCTCATATCTCAGTACGGACGAACAAAAAGATACTTTCCTTAAAGGTATCATTAAACT

GTTTAAGCGTATTAATGAGCGCGATATCGGGAAAAAGTTGATTAATTATCTTGTTGTGGGTTCCCCGTTCA

TGGGCGATAGCTCTACCCCCGAAGACACTTTTGATTTTACCCGTCATACGACAAACATCGCGGTAGAGAAG

TTTGAGAACGGATCGTGGAAAGTCACAAACATCATTACACCTAGCGTCTTAATTTTTGGTCCGCTGCCAAA

CATCTTAGATTATACAGCCAGCCTGACTTTGCAGGGGCAACAGTCGAATCCGAGTTTCGAAGGTTTTGGTA

CCCTGAGCATTCTGAAAGTTGCCCCGGAATTTCTGCTCACTTTTTCAGATGTCACCAGCAACCAGAGCTCA

GCAGTATTAGGAAAGTCAATTTTTTGCATGGACCCGGTTATTGCACTGATGCACGAACTGACGCACTCTCT

GCATCAACTGTATGGGATCAACATCCCCAGTGACAAACGTATTCGTCCCCAGGTGTCTGAAGGATTTTTCT

-continued

| SEQ IDs |
|---|

CACAGGATGGGCCGAACGTCCAGTTCGAAGAGTTGTATACTTTCGGAGGCCTGGACGTAGAGATCATTCCC

CAGATTGAGCGCAGTCAGCTGCGTGAGAAGGCATTGGGCCATTATAAGGATATTGCAAAACGCCTGAATAA

CATTAACAAAACGATTCCATCTTCGTGGATCTCGAATATTGATAAATATAAGAAAATTTTTAGCGAGAAAT

ATAATTTTGATAAAGATAATACAGGTAACTTTGTGGTTAACATTGACAAATTCAACTCCCTTTACAGTGAT

TTGACGAATGTAATGAGCGAAGTTGTGTATAGTTCCCAATACAACGTTAAGAATCGTACCCATTACTTCTC

TCGTCACTACCTGCCGGTTTTCGCGAACATCCTTGACGATAATATTTACACTATTCGTGACGGCTTTAACT

TGACCAACAAGGGCTTCAATATTGAAAATTCAGGCCAGAACATTGAACGCAACCCGGCCTTGCAGAAACTG

TCGAGTGAATCCGTGGTTGACCTGTTTACCAAAGTCTGCGTCGACAAAAGCGAAGAGAAGCTGTACGATGA

CGATGACAAAGATCGTTGGGGATCGTCCCTGCAGTGTATTAAAGTGAAAAACAATCGGCTGCCTTATGTAG

CAGATAAAGATAGCATTAGTCAGGAGATTTTCGAAAATAAAATTATCACTGACGAAACCAATGTTCAGAAT

TATTCAGATAAATTTTCACTGGACGAAAGCATCTTAGATGGCCAAGTTCCGATTAACCCGGAAATTGTTGA

TCCGTTACTGCCGAACGTGAATATGGAACCGTTAAACCTCCCTGGCGAAGAGATCGTATTTTATGATGACA

TTACGAAATATGTGGACTACCTTAATTCTTATTACTATTTGGAAAGCCAGAAACTGTCCAATAACGTGGAA

AACATTACTCTGACCACAAGCGTGGAAGAGGCTTTAGGCTACTCAAATAAGATTTATACCTTCCTCCCGTC

GCTGGCGGAAAAAGTAAATAAAGGTGTGCAGGCTGGTCTGTTCCTCAACTGGGCGAATGAAGTTGTCGAAG

ACTTTACCACGAATATTATGAAAAAGGATACCCTGGATAAAATCTCCGACGTCTCGGTTATTATCCCATAT

ATTGGCCCTGCGTTAAATATCGGTAATAGTGCGCTGCGGGGGAATTTTAACCAGGCCTTTGCTACCGCGGG

CGTCGCGTTCCTCCTGGAGGGCTTTCCTGAATTTACTATCCCGGCGCTCGGTGTTTTTACATTTTACTCTT

CCATCCAGGAGCGTGAGAAAATTATCAAAACCATCGAAAACTGCCTGGAGCAGCGGGTGAAACGCTGGAAA

GATTCTTATCAATGGATGGTGTCAAACTGGTTATCTCGCATCACGACCCAATTCAACCATATTAATTACCA

GATGTATGATAGTCTGTCGTACCAAGCTGACGCCATTAAAGCCAAAATTGATCTGGAATATAAAAAGTACT

CTGGTAGCGATAAGGAGAACATCAAAAGCCAGGTGGAGAACCTTAAGAATAGTCTGGATGTGAAAATCTCT

GAAGCTATGAATAACATTAACAAATTCATTCGTGAATGTTCGGTGACGTACCTGTTCAAGAATATGCTGCC

AAAAGTTATTGATGAACTGAATAAATTTGATCTGCGTACCAAAACCGAACTTATCAACCTCATCGACTCCC

ACAACATTATCCTTGTGGGCGAAGTGGATCGTCTGAAGGCCAAAGTAAACGAGAGCTTTGAAAATACGATG

CCGTTTAATATTTTTTCATATACCAATAACTCCTTGCTGAAAGATATCATCAATGAATATTTCAATCTAGA

AGGCGGTGGCGGTAGCGGCGGTGGCGGTAGCGGCGGTGGCGGTAGCGCACTAGTGCAGGAAAGACCTCCAT

TACAACAACCTCCACATCGCGATAAGAAACCATGTAAGAATTTCTTTTGGAAAACATTTAGCAGTTGCAAA taataagctt 18. Protein sequence of the CT-CST28-GS20-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

-continued

| SEQ IDs |
|---|

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVQERPPLQQPPHRDKKPCKNFFWKTFSSCK

19. Protein sequence of the CT-CST28-GS30-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSGGGGSGGGGSALVQERPPLQQPPHRDKKPCKNFFW

KTFSSCK

20. Protein sequence of the CT-SST14-GS15-L(#Fxa)HD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSIDGRNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYIDGRWGSSLQCIKVKNNRLPYVADKDSISQEIFENKIITDETNVQNYSDKFS

LDESILDGQVPINPEIVDPLLPNVNMEPLNLPGEEIVFYDDITKYVDYLNSYYYLESQKLSNNVENITLTT

SVEEALGYSNKIYTFLPSLAEKVNKGVQAGLFLNWANEVVEDFTTNIMKKDTLDKISDVSVIIPYIGPALN

IGNSALRGNFNQAFATAGVAFLLEGFPEFTIPALGVFTFYSSIQEREKIIKTIENCLEQRVKRWKDSYQWM

VSNWLSRITTQFNHINYQMYDSLSYQADAIKAKIDLEYKKYSGSDKENIKSQVENLKNSLDVKISEAMNNI

NKFIRECSVTYLFKNMLPKVIDELNKFDLRTKTELINLIDSHNIILVGEVDRLKAKVNESFENTMPFNIFS

YTNNSLLKDIINEYFNLEGGGGSGGGGSGGGGSALVAGCKNFFWKTFTSC

21. Protein sequence of the CT-SST14-GS30-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

-continued

| SEQ IDs |
|---|

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSGGGGSGGGGSALVAGCKNFFWKTFTSC

22. Protein sequence of the CT-SST28-GS20-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVSANSNPAMAPRERKAGCKNFFWKTFTSC

23. Protein sequence of the CT-SST28-GS30-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSGGGGSGGGGSALVSANSNPAMAPRERKAGCKNFFW

KTFTSC

24. Protein sequence of the CT-SST14-GS35-LHC fusion
PITINNFNYSDPVDNKNILYLDTHLNTLANEPEKAFRITGNIWVIPDRFSRNSNPNLNKPPRVTSPKSGYY

DPNYLSTDSDKDTFLKEIIKLFKRINSREIGEELIYRLSTDIPFPGNNNTPINTFDFDVDFNSVDVKTRQG

NNWVKTGSINPSVIITGPRENIIDPETSTFKLTNNTFAAQEGFGALSIISISPRFMLTYSNATNDVGEGRF

-continued

| SEQ IDs |
|---|
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDAIDGRSLYNKTLQCRELLVKNTDLPFIGDISDVKTDIFLRKDINEETEVIYYPDNVSVD |
| QVILSKNTSEHGQLDLLYPSIDSESEILPGENQVFYDNRTQNVDYLNSYYYLESQKLSDNVEDFTFTRSIE |
| EALDNSAKVYTYFPTLANKVNAGVQGGLFLMWANDVVEDFTTNILRKDTLDKISDVSAIIPYIGPALNISN |
| SVRRGNFTEAFAVTGVTILLEAFPPEFTIPALGAFVIYSKVQERNEIIKTIDNCLEQRIKRWKDSYEWMMGT |
| WLSRIITQFNNISYQMYDSLNYQAGAIKAKIDLEYKKYSGSDKENIKSQVENLKNSLDVKISEAMNNINKF |
| IRECSVTYLFKNMLPKVIDELNEFDRNTKAKLINLIDSHNIILVGEVDKLKAKVNNSFQNTIPFNIFSYTN |
| NSLLKDIINEYFNLEGGGGSGGGGSGGGGSGGGGSGGGGSGGGGSGGGGSALVAGCKNFFWKTFTSC |
| 25. DNA sequence of the CP-SST28-GS15-LHA fusion<br>ggatccATGGAGTTCGTTAACAAACAGTTCAACTATAAAGACCCAGTTAACGGTGTTGACATTGCTTACAT |
| CAAAATCCCGAACGCTGGCCAGATGCAGCCGGTAAAGGCATTCAAAATCCACAACAAAATCTGGGTTATCC |
| CGGAACGTGATACCTTTACTAACCCGGAAGAAGGTGACCTGAACCCGCCACCGGAAGCGAAACAGGTGCCG |
| GTATCTTACTATGACTCCACCTACCTGTCTACCGATAACGAAAAGGACAACTACCTGAAAGGTGTTACTAA |
| ACTGTTCGAGCGTATTTACTCCACCGACCTGGGCCGTATGCTGCTGACTAGCATCGTTCGCGGTATCCCGT |
| TCTGGGGCGGTTCTACCATCGATACCGAACTGAAAGTAATCGACACTAACTGCATCAACGTTATTCAGCCG |
| GACGGTTCCTATCGTTCCGAAGAACTGAACCTGGTGATCATCGGCCCGTCTGCTGATATCATCCAGTTCGA |
| GTGTCTGAGCTTTGGTCACGAAGTTCTGAACCTCACCCGTAACGGCTACGGTTCCACTCAGTACATCCGTT |
| TCTCTCCGGACTTCACCTTCGGTTTTGAAGAATCCCTGGAAGTAGACACGAACCCACTGCTGGGCGCTGGT |
| AAATTCGCAACTGATCCTGCGGTTACCCTGGCTCACGAACTGATTCATGCAGGCCACCGCCTGTACGGTAT |
| CGCCATCAATCCGAACCGTGTCTTCAAAGTTAACACCAACGCGTATTACGAGATGTCCGGTCTGGAAGTTA |
| GCTTCGAAGAACTGCGTACTTTTGGCGGTCACGACGCTAAATTCATCGACTCTCTGCAAGAAAACGAGTTC |
| CGTCTGTACTACTATAACAAGTTCAAAGATATCGCATCCACCCTGAACAAAGCGAAATCCATCGTGGGTAC |
| CACTGCTTCTCTCCAGTACATGAAGAACGTTTTTAAAGAAAAATACCTGCTCAGCGAAGACACCTCCGGCA |
| AATTCTCTGTAGACAAGTTGAAATTCGATAAACTTTACAAAATGCTGACTGAAATTTACACCGAAGACAAC |
| TTCGTTAAGTTCTTTAAAGTTCTGAACCGCAAAACCTATCTGAACTTCGACAAGGCAGTATTCAAAATCAA |
| CATCGTGCCGAAAGTTAACTACACTATCTACGATGGTTTCAACCTGCGTAACACCAACCTGGCTGCTAATT |
| TTAACGGCCAGAACACGGAAATCAACAACATGAACTTCACAAAACTGAAAAACTTCACTGGTCTGTTCGAG |
| TTTTACAAGCTGCTGTGCGTCGACGGCATCATTACCTCCAAAACTAAATCTGACGATGACGATAAAAGCGC |
| CAATTCAAATCCTGCAATGGCGCCACGCGAACGCAAAGCTGGATGCAAAAACTTCTTTTGGAAGACATTTA |
| CTAGTTGTGCGCTAGCGGGCGGTGGCGGTAGCGGCGGTGGCGGTAGCGGCGGTGGCGGTAGCGCACTAGTG |
| CTGCAGTGTATCAAGGTTAACAACTGGGATTTATTCTTCAGCCCGAGTGAAGACAACTTCACCAACGACCT |
| GAACAAAGGTGAAGAAATCACCTCAGATACTAACATCGAAGCAGCCGAAGAAAACATCTCGCTGGACCTGA |
| TCCAGCAGTACTACCTGACCTTTAATTTCGACAACGAGCCGGAAAACATTTCTATCGAAAACCTGAGCTCT |
| GATATCATCGGCCAGCTGGAACTGATGCCGAACATCGAACGTTTCCCAAACGGTAAAAAGTACGAGCTGGA |
| CAAATATACCATGTTCCACTACCTGCGCGCGCAGGAATTTGAACACGGCAAATCCCGTATCGCACTGACTA |
| ACTCCGTTAACGAAGCTCTGCTCAACCCGTCCCGTGTATACACCTTCTTCTCTAGCGACTACGTGAAAAAG |
| GTCAACAAAGCGACTGAAGCTGCAATGTTCTTGGGTTGGGTTGAACAGCTTGTTTATGATTTTACCGACGA |

-continued

| SEQ IDs |
|---|

GACGTCCGAAGTATCTACTACCGACAAAATTGCGGATATCACTATCATCATCCCGTACATCGGTCCGGCTC

TGAACATTGGCAACATGCTGTACAAAGACGACTTCGTTGGCGCACTGATCTTCTCCGGTGCGGTGATCCTG

CTGGAGTTCATCCCGGAAATCGCCATCCCGGTACTGGGCACCTTTGCTCTGGTTTCTTACATTGCAAACAA

GGTTCTGACTGTACAAACCATCGACAACGCGCTGAGCAAACGTAACGAAAAATGGGATGAAGTTTACAAAT

ATATCGTGACCAACTGGCTGGCTAAGGTTAATACTCAGATCGACCTCATCCGCAAAAAAATGAAAGAAGCA

CTGGAAAACCAGGCGGAAGCTACCAAGGCAATCATTAACTACCAGTACAACCAGTACACCGAGGAAGAAAA

AAACAACATCAACTTCAACATCGACGATCTGTCCTCTAAACTGAACGAATCCATCAACAAAGCTATGATCA

ACATCAACAAGTTCCTGAACCAGTGCTCTGTAAGCTATCTGATGAACTCCATGATCCCGTACGGTGTTAAA

CGTCTGGAGGACTTCGATGCGTCTCTGAAAGACGCCCTGCTGAAATACATTTACGACAACCGTGGCACTCT

GATCGGTCAGGTTGATCGTCTGAAGGACAAAGTGAACAATACCTTATCGACCGACATCCCTTTTCAGCTCA

GTAAATATGTCGATAACCAACGCCTTTTGTCCACTtaataagctt

26. Protein sequence of the CP-SST28-GS15-LHA fusion
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECLSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGIITSKTKSDDDDKSANSNPAMAPRERKAGCKNFFWKTFTSCALAGGGGSGGGGSGGGGSALVLQC

IKVNNWDLFFSPSEDNFTNDLNKGEEITSDTNIEAAEENISLDLIQQYYLTFNFDNEPENISIENLSSDII

GQLELMPNIERFPNGKKYELDKYTMFHYLRAQEFEHGKSRIALTNSVNEALLNPSRVYTFFSSDYVKKVNK

ATEAAMFLGWVEQLVYDFTDETSEVSTTDKIADITIIIPYIGPALNIGNMLYKDDFVGALIFSGAVILLEF

IPEIAIPVLGTFALVSYIANKVLTVQTIDNALSKRNEKWDEVYKYIVTNWLAKVNTQIDLIRKKMKEALEN

QAEATKAIINYQYNQYTEEEKNNINFNIDDLSSKLNESINKAMININKFLNQCSVSYLMNSMIPYGVKRLE

DFDASLKDALLKYIYDNRGTLIGQVDRLKDKVNNTLSTDIPFQLSKYVDNQRLLST

27. Protein sequence of the CT-SST28-GS15-LHB fusion
PVTINNFNYNDPIDNNNIIMMEPPFARGTGRYYKAFKITDRIWIIPERYTFGYKPEDFNKSSGIFNRDVCE

YYDPDYLNTNDKKNIFLQTMIKLFNRIKSKPLGEKLLEMIINGIPYLGDRRVPLEEFNTNIASVTVNKLIS

NPGEVERKKGIFANLIIFGPGPVLNENETIDIGIQNHFASREGFGGIMQMKFCPEYVSVFNNVQENKGASI

FNRRGYFSDPALILMHELIHVLHGLYGIKVDDLPIVPNEKKFFMQSTDAIQAEELYTFGGQDPSIITPSTD

KSIYDKVLQNFRGIVDRLNKVLVCISDPNININIYKNKFKDKYKFVEDSEGKYSIDVESFDKLYKSLMFGF

TETNIAENYKIKTRASYFSDSLPPVKIKNLLDNEIYTIEEGFNISDKDMEKEYRGQNKAINKQAYEEISKE

HLAVYKIQMCVDGIITSKTKSDDDDKNKALNLQCIDVDNEDLFFIADKNSFSDDLSKNERIEYNTQSNYIE

NDFPINELILDTDLISKIELPSENTESLTDFNVDVPVYEKQPAIKKIFTDENTIFQYLYSQTFPLDIRDIS

LTSSFDDALLFSNKVYSFFSMDYIKTANKVVEAGLFAGWVKQIVNDFVIEANKSNTMDKIADISLIVPYIG

LALNVGNETAKGNFENAFEIAGASILLEFIPELLIPVVGAFLLESYIDNKNKIIKTIDNALTKRNEKWSDM

YGLIVAQWLSTVNTQFYTIKEGMYKALNYQAQALEEIIKYRYNIYSEKEKSNINIDFNDINSKLNEGINQA

IDNINNFINGCSVSYLMKKMIPLAVEKLLDFDNTLKKNLLNYIDENKLYLIGSAEYEKSKVNKYLKTIMPF

DLSIYTNDTILIEMFNKYNSLEGGGGSGGGGSGGGGSALDSANSNPAMAPRERKAGCKNFFWKTFTSC

-continued

| SEQ IDs |
|---|
| 28. Protein sequence of the CT-CST14-GS20-LHC fusion<br>PITINNFNYSDPVDNKNILYLDTHLNTLANEPEKAFRITGNIWVIPDRFSRNSNPNLNKPPRVTSPKSGYY<br>DPNYLSTDSDKDTFLKEIIKLFKRINSREIGEELIYRLSTDIPFPGNNNTPINTFDFDVDFNSVDVKTRQG<br>NNWVKTGSINPSVIITGPRENIIDPETSTFKLTNNTFAAQEGFGALSIISISPRFMLTYSNATNDVGEGRF<br>SKSEFCMDPILILMHELNHAMHNLYGIAIPNDQTISSVTSNIFYSQYNVKLEYAEIYAFGGPTIDLIPKSA<br>RKYFEEKALDYYRSIAKRLNSITTANPSSFNKYIGEYKQKLIRKYRFVVESSGEVTVNRNKFVELYNELTQ<br>IFTEFNYAKIYNVQNRKIYLSNVYTPVTANILDDNVYDIQNGFNIPKSNLNVLFMGQNLSRNPALRKVNPE<br>NMLYLFTKFCVDAIDGRSLYNKTLQCRELLVKNTDLPFIGDISDVKTDIFLRKDINEETEVIYYPDNVSVD<br>QVILSKNTSEHGQLDLLYPSIDSESEILPGENQVFYDNRTQNVDYLNSYYYLESQKLSDNVEDFTFTRSIE<br>EALDNSAKVYTYFPTLANKVNAGVQGGLFLMWANDVVEDFTTNILRKDTLDKISDVSAIIPYIGPALNISN<br>SVRRGNFTEAFAVTGVTILLEAFPEFTIPALGAFVIYSKVQERNEIIKTIDNCLEQRIKRWKDSYEWMMGT<br>WLSRIITQFNNISYQMYDSLNYQAGAIKAKIDLEYKKYSGSDKENIKSQVENLKNSLDVKISEAMNNINKF<br>IRECSVTYLFKNMLPKVIDELNEFDRNTKAKLINLIDSHNIILVGEVDKLKAKVNNSFQNTIPFNIFSYTN<br>NSLLKDIINEYFNLEGGGGSGGGGSGGGGSGGGGSALVAGCKNFFWKTFTSC |
| 29. Protein sequence of the CT-CST17-GS25-LHC fusion<br>PITINNFNYSDPVDNKNILYLDTHLNTLANEPEKAFRITGNIWVIPDRFSRNSNPNLNKPPRVTSPKSGYY<br>DPNYLSTDSDKDTFLKEIIKLFKRINSREIGEELIYRLSTDIPFPGNNNTPINTFDFDVDFNSVDVKTRQG<br>NNWVKTGSINPSVIITGPRENIIDPETSTFKLTNNTFAAQEGFGALSIISISPRFMLTYSNATNDVGEGRF<br>SKSEFCMDPILILMHELNHAMHNLYGIAIPNDQTISSVTSNIFYSQYNVKLEYAEIYAFGGPTIDLIPKSA<br>RKYFEEKALDYYRSIAKRLNSITTANPSSFNKYIGEYKQKLIRKYRFVVESSGEVTVNRNKFVELYNELTQ<br>IFTEFNYAKIYNVQNRKIYLSNVYTPVTANILDDNVYDIQNGFNIPKSNLNVLFMGQNLSRNPALRKVNPE<br>NMLYLFTKFCVDAIDGRSLYNKTLQCRELLVKNTDLPFIGDISDVKTDIFLRKDINEETEVIYYPDNVSVD<br>QVILSKNTSEHGQLDLLYPSIDSESEILPGENQVFYDNRTQNVDYLNSYYYLESQKLSDNVEDFTFTRSIE<br>EALDNSAKVYTYFPTLANKVNAGVQGGLFLMWANDVVEDFTTNILRKDTLDKISDVSAIIPYIGPALNISN<br>SVRRGNFTEAFAVTGVTILLEAFPEFTIPALGAFVIYSKVQERNEIIKTIDNCLEQRIKRWKDSYEWMMGT<br>WLSRIITQFNNISYQMYDSLNYQAGAIKAKIDLEYKKYSGSDKENIKSQVENLKNSLDVKISEAMNNINKF<br>IRECSVTYLFKNMLPKVIDELNEFDRNTKAKLINLIDSHNIILVGEVDKLKAKVNNSFQNTIPFNIFSYTN<br>NSLLKDIINEYFNLEGGGGSGGGGSGGGGSGGGGSGGGGSALVDRMPCRNFFWKTFSSCK |
| 30. Protein sequence of the CT-CST29-GS15-LHA fusion<br>EFVNKQFNYKDPVNGVDIAYIKIPNAGQMQPVKAFKIHNKIWVIPERDTFTNPEEGDLNPPPEAKQVPVSY<br>YDSTYLSTDNEKDNYLKGVTKLFERIYSTDLGRMLLTSIVRGIPFWGGSTIDTELKVIDTNCINVIQPDGS<br>YRSEELNLVIIGPSADIIQFECLSFGHEVLNLTRNGYGSTQYIRFSPDFTFGFEESLEVDTNPLLGAGKFA<br>TDPAVTLAHELIHAGHRLYGIAINPNRVFKVNTNAYYEMSGLEVSFEELRTFGGHDAKFIDSLQENEFRLY<br>YYNKFKDIASTLNKAKSIVGTTASLQYMKNVFKEKYLLSEDTSGKFSVDKLKFDKLYKMLTEIYTEDNFVK<br>FFKVLNRKTYLNFDKAVFKINIVPKVNYTIYDGFNLRNTNLAANFNGQNTEINNMNFTKLKNFTGLFEFYK<br>LLCVDGIITSKTKSDDDDKNKALNLQCIKVNNWDLFFSPSEDNFTNDLNKGEEITSDTNIEAAEENISLDL<br>IQQYYLTFNFDNEPENISIENLSSDIIGQLELMPNIERFPNGKKYELDKYTMFHYLRAQEFEHGKSRIALT<br>NSVNEALLNPSRVYTFFSSDYVKKVNKATEAAMFLGWVEQLVYDFTDETSEVSTTDKIADITIIIPYIGPA<br>LNIGNMLYKDDFVGALIFSGAVILLEFIPEIAIPVLGTFALVSYIANKVLTVQTIDNALSKRNEKWDEVYK<br>YIVTNWLAKVNTQIDLIRKKMKEALENQAEATKAIINYQYNQYTEEEKNNINFNIDDLSSKLNESINKAMI |

-continued

| SEQ IDs |
| --- |
| NINKFLNQCSVSYLMNSMIPYGVKRLEDFDASLKDALLKYIYDNRGTLIGQVDRLKDKVNNTLSTDIPFQL |
| SKYVDNQRLLSTLEGGGGSGGGGSGGGGSALVQEGAPPQQSARRDRMPCRNFFWKTFSSCK |
| 31. Protein sequence of the CT-CST29-GS30-LHB fusion<br>PVTINNFNYNDPIDNNNIIMMEPPFARGTGRYYKAFKITDRIWIIPERYTFGYKPEDFNKSSGIFNRDVCE |
| YYDPDYLNTNDKKNIFLQTMIKLFNRIKSKPLGEKLLEMIINGIPYLGDRRVPLEEFNTNIASVTVNKLIS |
| NPGEVERKKGIFANLIIFGPGPVLNENETIDIGIQNHFASREGFGGIMQMKFCPEYVSVFNNVQENKGASI |
| FNRRGYFSDPALILMHELIHVLHGLYGIKVDDLPIVPNEKKFFMQSTDAIQAEELYTFGGQDPSIITPSTD |
| KSIYDKVLQNFRGIVDRLNKVLVCISDPNININIYKNKFKDKYKFVEDSEGKYSIDVESFDKLYKSLMFGF |
| TETNIAENYKIKTRASYFSDSLPPVKIKNLLDNEIYTIEEGFNISDKDMEKEYRGQNKAINKQAYEEISKE |
| HLAVYKIQMCVDGIITSKTKSDDDDKNKALNLQCIDVDNEDLFFIADKNSFSDDLSKNERIEYNTQSNYIE |
| NDFPINELILDTDLISKIELPSENTESLTDFNVDVPVYEKQPAIKKIFTDENTIFQYLYSQTFPLDIRDIS |
| LTSSFDDALLFSNKVYSFFSMDYIKTANKVVEAGLFAGWVKQIVNDFVIEANKSNTMDKIADISLIVPYIG |
| LALNVGNETAKGNFENAFEIAGASILLEFIPELLIPVVGAFLLESYIDNKNKIIKTIDNALTKRNEKWSDM |
| YGLIVAQWLSTVNTQFYTIKEGMYKALNYQAQALEEIIKYRYNIYSEKEKSNINIDFNDINSKLNEGINQA |
| IDNINNFINGCSVSYLMKKMIPLAVEKLLDFDNTLKKNLLNYIDENKLYLIGSAEYEKSKVNKYLKTIMPF |
| DLSIYTNDTILIEMFNKYNSLEGGGGSGGGGSGGGGSGGGGSGGGGSGGGGSALDQEGAPPQQSARRDRMP |
| CRNFFWKTFSSCK |
| 32. DNA sequence of IgA-$H_N$tet<br>ggatccATGGAGTCCAATCAGCCGGAAAAAAATGGAACCGCGACTAAACCCGAGAATTCGGGGAACACTAC |
| GTCGGAAAACGGCCAGACGGAACCTGAGAAGAAACTGGAACTACGAAATGTGTCCGATATCGAGCTATACT |
| CTCAAACCAATGGAACCTATAGGCAGCATGTTTCATTGGACGGAATCCCAGAAAATACGGATACATATTTC |
| GTCAAAGTGAAGTCTAGCGCATTCAAGGATGTATATATCCCCGTTGCGAGTATTACAGAAGAGAAGCGGAA |
| CGGTCAAAGCGTTTATAAGATTACAGCAAAGGCCGAAAAGTTACAACAGGAGTTAGAAAACAAATACGTTG |
| ACAATTTCACTTTTTATCTCGATAAAAAGGCTAAAGAGGAAAACACGAACTTCACGTCATTTAGTAATCTG |
| GTCAAAGCCATAAATCAAAATCCATCTGGTACATACCATCTCGCGGCAAGTCTAAACGCGAATGAAGTAGA |
| ACTTGGCCCGGACGAGCGTTCATACATTAAGGATACCTTTACTGGCAGACTCATAGGGGAAAAAGACGGTA |
| AGAACTATGCTATATACAATTTGAAAAAGCCTTTATTTGAGAACCTGTCGGGCGCCACCGTCGAGAAATTG |
| TCCCTTAAAAACGTAGCTATAAGCGGAAAGAATGACATCGGTAGTCTTGCAAACGAGGCTACTAACGGGAC |
| AAAGATTAAACAAGTGCACGTAGATGGGtgtgtcgacggcatcattacctccaaaactaaatctgacgatg |
| acgataaaaacaaagcgctgaacctgcagtgcattaaaataaagaatgaggatttgacattcatcgcagaa |
| aaaaatagcttcagcgaagagccgttccaagatgagatagtaagctacaacaccaagaacaagccgcttaa |
| ttttaattactcgttagataaaatcatagttgactacaaccttcaatcgaagatcacgttaccgaatgaca |
| gaacaactcctgtcacaaaaggaattccctatgcacctgagtataagtcaaatgccgcgtcaacaatagag |
| attcataatatagatgacaacaccatctatcaatatctgtacgctcagaaaagtccaacaactcttcagcg |
| tataacaatgaccaatagtgtcgatgacgcattgataaattctaccaagatatactcttatttcccgagcg |
| tcatctccaaagttaatcaaggtgctcaaggcattctatttttgcaatgggtccgagacatcatagatgac |
| ttcactaatgagtcgtctcagaaaaccacgattgataaaatatcagatgtttccaccatcgtcccctacat |
| cggacctgcgcttaacattgtgaagcaggggtatgaggggaattttatcggagcgttagaaactacggggg |
| ttgtgctattacttgaatacataccagagataacattgcccgttatagcggccctcagtatcgcagaatca |
| agtacacaaaaagaaaagataatcaaaacaatcgacaacttcctagaaaagaggtacgaaaaatggataga |

-continued

| SEQ IDs |
|---|

ggtttataaactcgtgaaagcgaaatggttaggcactgttaatacgcagttccaaaagagatcctatcaaa tgtatagatcactggagtaccaggtggatgccataaagaaaattatcgactatgaatataaaatatattca ggtccagataaggagcagatagctgatgaaataaacaatttaaaaaacaaacttgaagagaaggcgaataa ggccatgatcaatatcaatatttttatgcgagaatcttcacgatctttttggtaaatcagatgattaacg aagccaaaaagcagctgcttgagttcgacacacagtccaaaaacatactaatgcaatatatcaaagcaaac tcaaaattcattggaattactgagctgaagaaactggaatccaaaataaataaagtattctctaccccgat cccgttctcttactctaaaaaccttgactgctgggtagataacgaagaagatattgacgttctagagtaat aagctt 33. Protein sequence of the CT-GHRP-LHC fusion
PITINNFNYSDPVDNKNILYLDTHLNTLANEPEKAFRITGNIWVIPDRFSRNSNPNLNKPPRVTSPKSGYY

DPNYLSTDSDKDTFLKEIIKLFKRINSREIGEELIYRLSTDIPFPGNNNTPINTFDFDVDFNSVDVKTRQG

NNWVKTGSINPSVIITGPRENIIDPETSTFKLTNNTFAAQEGFGALSIISISPRFMLTYSNATNDVGEGRF

SKSEFCMDPILILMHELNHAMHNLYGIAIPNDQTISSVTSNIFYSQYNVKLEYAEIYAFGGPTIDLIPKSA

RKYFEEKALDYYRSIAKRLNSITTANPSSFNKYIGEYKQKLIRKYRFVVESSGEVTVNRNKFVELYNELTQ

IFTEFNYAKIYNVQNRKIYLSNVYTPVTANILDDNVYDIQNGFNIPKSNLNVLFMGQNLSRNPALRKVNPE

NMLYLFTKFCVDAIDGRSLYNKTLQCRELLVKNTDLPFIGDISDVKTDIFLRKDINEETEVIYYPDNVSVD

QVILSKNTSEHGQLDLLYPSIDSESEILPGENQVFYDNRTQNVDYLNSYYYLESQKLSDNVEDFTFTRSIE

EALDNSAKVYTYFPTLANKVNAGVQGGLFLMWANDVVEDFTTNILRKDTLDKISDVSAIIPYIGPALNISN

SVRRGNFTEAFAVTGVTILLEAFPEFTIPALGAFVIYSKVQERNEIIKTIDNCLEQRIKRWKDSYEWMMGT

WLSRIITQFNNISYQMYDSLNYQAGAIKAKIDLEYKKYSGSDKENIKSQVENLKNSLDVKISEAMNNINKF

IRECSVTYLFKNMLPKVIDELNEFDRNTKAKLINLIDSHNIILVGEVDKLKAKVNNSFQNTIPFNIFSYTN

NSLLKDIINEYFNLEGGGGSGGGGSGGGGSALVGSSFLSPEHQRVQQRKESKKPPAKLQPR

34. Protein sequence of the CT-GHRH-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVYADAIFTNSYRKVLGQLSARKLLQDIMSRQQG

ESNQERGA

35. Protein sequence of the CT-GHRP-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

-continued

| SEQ IDs |
| --- |

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVGSSFLSPEHQRVQQRKESKKPPAKLQPR

36. Protein sequence of the CT-ghrelin-LHA fusion
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECKSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGIITSKTKSDDDDKNKALNLQCIKVNNWDLFFSPSEDNFTNDLNKGEEITSDTNIEAAEENISLDL

IQQYYLTFNFDNEPENISIENLSSDIIGQLELMPNIERFPNGKKYELDKYTMFHYLRAQEFEHGKSRIALT

NSVNEALLNPSRVYTFFSSDYVKKVNKATEAAMFLGWVEQLVYDFTDETSEVSTTDKIADITIIIPYIGPA

LNIGNMLYKDDFVGALIFSGAVILLEFIPEIAIPVLGTFALVSYIANKVLTVQTIDNALSKRNEKWDEVYK

YIVTNWLAKVNTQIDLIRKKMKEALENQAEATKAIINYQYNQYTEEEKNNINFNIDDLSSKLNESINKAMI

NINKFLNQCSVSYLMNSMIPYGVKRLEDFDASLKDALLKYIYDNRGTLIGQVDRLKDKVNNTLSTDIPFQL

SKYVDNQRLLSTLEGGGGSGGGGSGGGGSALVGSSFLSPEHQRVQQRKESKKPPAKLQPR

37. Protein sequence of the IgA-$H_N$tet-CT-SST14 Fusion
ESNQPEKNGTATKPENSGNTTSENGQTEPEKKLELRNVSDIELYSQTNGTYRQHVSLDGIPENTDTYFVKVKS

SAFKDVYIPVASITEEKRNGQSVYKITAKAEKLQQELENKYVDNFTFYLDKKAKEENTNFTSFSNLVKAINQN

PSGTYHLAASLNANEVELGPDERSYIKDTFTGRLIGEKDGKNYAIYNLKKPLFENLSGATVEKLSLKNVAISG

KNDIGSLANEATNGTKIKQVHVDGCVDGIITSKTKSDDDDKNKALNLQCIKIKNEDLTFIAEKNSFSEEPFQD

EIVSYNTKNKPLNFNYSLDKIIVDYNLQSKITLPNDRTTPVTKGIPYAPEYKSNAASTIEIHNIDDNTIYQYL

YAQKSPTTLQRITMTNSVDDALINSTKIYSYFPSVISKVNQGAQGILFLQWVRDIIDDFTNESSQKTTIDKIS

DVSTIVPYIGPALNIVKQGYEGNFIGALETTGVVLLLEYIPEITLPVIAALSIAESSTQKEKIIKTIDNFLEK

RYEKWIEVYKLVKAKWLGTVNTQFQKRSYQMYRSLEYQVDAIKKIIDYEYKIYSGPDKEQIADEINNLKNKLE

EKANKAMININIFMRESSRSFLVNQMINEAKKQLLEFDTQSKNILMQYIKANSKFIGITELKKLESKINKVFS

TPIPFSYSKNLDCWVDNEEDIDVLEGGGGSGGGGSGGGGSALVAGCKNFFWKTFTSC

38. Protein sequence of the IgA-$H_N$tet-CT-GHRP Fusion
ESNQPEKNGTATKPENSGNTTSENGQTEPEKKLELRNVSDIELYSQTNGTYRQHVSLDGIPENTDTYFVKVKS

SAFKDVYIPVASITEEKRNGQSVYKITAKAEKLQQELENKYVDNFTFYLDKKAKEENTNFTSFSNLVKAINQN

PSGTYHLAASLNANEVELGPDERSYIKDTFTGRLIGEKDGKNYAIYNLKKPLFENLSGATVEKLSLKNVAISG

-continued

| SEQ IDs |
|---|

KNDIGSLANEATNGTKIKQVHVDGCVDGIITSKTKSDDDDKNKALNLQCIKIKNEDLTFIAEKNSFSEEPFQD

EIVSYNTKNKPLNFNYSLDKIIVDYNLQSKITLPNDRTTPVTKGIPYAPEYKSNAASTIEIHNIDDNTIYQYL

YAQKSPTTLQRITMTNSVDDALINSTKIYSYFPSVISKVNQGAQGILFLQWVRDIIDDFTNESSQKTTIDKIS

DVSTIVPYIGPALNIVKQGYEGNFIGALETTGVVLLLEYIPEITLPVIAALSIAESSTQKEKIIKTIDNFLEK

RYEKWIEVYKLVKAKWLGTVNTQFQKRSYQMYRSLEYQVDAIKKIIDYEYKIYSGPDKEQIADEINNLKNKLE

EKANKAMININIFMRESSRSFLVNQMINEAKKQLLEFDTQSKNILMQYIKANSKFIGITELKKLESKINKVFS

TPIPFSYSKNLDCWVDNEEDIDVLEGGGGSGGGGSGGGGSALVGSSFLSPEHQRVQQRKESKKPPAKLQPR

39. Protein sequence of the CT-ghrelin S3W-LHA fusion
EFVNKQFNYKDPVNGVDIAYIKIPNAGQMQPVKAFKIHNKIWVIPERDTFTNPEEGDLNPPPEAKQVPVSYYD

STYLSTDNEKDNYLKGVTKLFERIYSTDLGRMLLTSIVRGIPFWGGSTIDTELKVIDTNCINVIQPDGSYRSE

ELNLVIIGPSADIIQFECKSFGHEVLNLTRNGYGSTQYIRFSPDFTFGFEESLEVDTNPLLGAGKFATDPAVT

LAHELIHAGHRLYGIAINPNRVFKVNTNAYYEMSGLEVSFEELRTFGGHDAKFIDSLQENEFRLYYYNKFKDI

ASTLNKAKSIVGTTASLQYMKNVFKEKYLLSEDTSGKFSVDKLKFDKLYKMLTEIYTEDNFVKFFKVLNRKTY

LNFDKAVFKINIVPKVNYTIYDGFNLRNTNLAANFNGQNTEINNMNFTKLKNFTGLFEFYKLLCVDGIITSKT

KSDDDDKNKALNLQCIKVNNWDLFFSPSEDNFTNDLNKGEEITSDTNIEAAEENISLDLIQQYYLTFNFDNEP

ENISIENLSSDIIGQLELMPNIERFPNGKKYELDKYTMFHYLRAQEFEHGKSRIALTNSVNEALLNPSRVYTF

FSSDYVKKVNKATEAAMFLGWVEQLVYDFTDETSEVSTTDKIADITIIIPYIGPALNIGNMLYKDDFVGALIF

SGAVILLEFIPEIAIPVLGTFALVSYIANKVLTVQTIDNALSKRNEKWDEVYKYIVTNWLAKVNTQIDLIRKK

MKEALENQAEATKAIINYQYNQYTEEEKNNINFNIDDLSSKLNESINKAMININKFLNQCSVSYLMNSMIPYG

VKRLEDFDASLKDALLKYIYDNRGTLIGQVDRLKDKVNNTLSTDIPFQLSKYVDNQRLLSTLEIYALVGSWFL

SPEHQRVQQRKESKKPPAKLQPR

40. Protein sequence of the CT-GRP-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVGNHWAVGHLM

41. Protein sequence of the CT-GRP-LHB fusion
PVTINNFNYNDPIDNNNIIMMEPPFARGTGRYYKAFKITDRIWIIPERYTFGYKPEDFNKSSGIFNRDVCE

YYDPDYLNTNDKKNIFLQTMIKLFNRIKSKPLGEKLLEMIINGIPYLGDRRVPLEEFNTNIASVTVNKLIS

NPGEVERKKGIFANLIIFGPGPVLNENETIDIGIQNHFASREGFGGIMQMKFCPEYVSVFNNVQENKGASI

FNRRGYFSDPALILMHELIHVLHGLYGIKVDDLPIVPNEKKFFMQSTDAIQAEELYTFGGQDPSIITPSTD

-continued

| SEQ IDs |
| --- |

KSIYDKVLQNFRGIVDRLNKVLVCISDPNININIYKNKFKDKYKFVEDSEGKYSIDVESFDKLYKSLMFGF

TETNIAENYKIKTRASYFSDSLPPVKIKNLLDNEIYTIEEGFNISDKDMEKEYRGQNKAINKQAYEEISKE

HLAVYKIQMCVDEEKLYDDDDKDRWGSSLQCIDVDNEDLFFIADKNSFSDDLSKNERIEYNTQSNYIENDF

PINELILDTDLISKIELPSENTESLTDFNVDVPVYEKQPAIKKIFTDENTIFQYLYSQTFPLDIRDISLTS

SFDDALLFSNKVYSFFSMDYIKTANKVVEAGLFAGWVKQIVNDFVIEANKSNTMDAIADISLIVPYIGLAL

NVGNETAKGNFENAFEIAGASILLEFIPELLIPVVGAFLLESYIDNKNKIIKTIDNALTKRNEKWSDMYGL

IVAQWLSTVNTQFYTIKEGMYKALNYQAQALEEIIKYRYNIYSEKEKSNINIDFNDINSKLNEGINQAIDN

INNFINGCSVSYLMKKMIPLAVEKLLDFDNTLKKNLLNYIDENKLYLIGSAEYEKSKVNKYLKTIMPFDLS

IYTNDTILIEMFNKYNSLEGGGGSGGGGSGGGGSALVGNHWAVGHLM

42. Protein sequence of the CP-qGHRH29-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDNNNNNNNNNNDDDDKHVDAIFTQSYRKVLAQLSARKLLQDILNRAEAAAKEAAAKALQC

IKVKNNRLPYVADKDSISQEIFENKIITDETNVQNYSDKFSLDESILDGQVPINPEIVDPLLPNVNMEPLN

LPGEEIVFYDDITKYVDYLNSYYYLESQKLSNNVENITLTTSVEEALGYSNKIYTFLPSLAEKVNKGVQAG

LFLNWANEVVEDFTTNIMKKDTLDKISDVSVIIPYIGPALNIGNSALRGNFNQAFATAGVAFLLEGFPEFT

IPALGVFTFYSSIQEREKIIKTIENCLEQRVKRWKDSYQWMVSNWLSRITTQFNHINYQMYDSLSYQADAI

KAKIDLEYKKYSGSDKENIKSQVENLKNSLDVKISEAMNNINKFIRECSVTYLFKNMLPKVIDELNKFDLR

TKTELINLIDSHNIILVGEVDRLKAKVNESFENTMPFNIFSYTNNSLLKDIINEYFN

43. Protein sequence of the CP-qGHRH-LHA fusion
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECKSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGIITSKTKSLIEGRHVDAIFTQSYRKVLAQLSARKLLQDILNRQQGERNQEQGALAGGGGSGGGGS

GGGGSALVLQCIKVNNWDLFFSPSEDNFTNDLNKGEEITSDTNIEAAEENISLDLIQQYYLTFNFDNEPEN

ISIENLSSDIIGQLELMPNIERFPNGKKYELDKYTMFHYLRAQEFEHGKSRIALTNSVNEALLNPSRVYTF

FSSDYVKKVNKATEAAMFLGWVEQLVYDFTDETSEVSTTDKIADITIIIPYIGPALNIGNMLYKDDFVGAL

IFSGAVILLEFIPEIAIPVLGTFALVSYIANKVLTVQTIDNALSKRNEKWDEVYKYIVTNWLAKVNTQIDL

IRKKMKEALENQAEATKAIINYQYNQYTEEEKNNINFNIDDLSSKLNESINKAMININKFLNQCSVSYLMN

SMIPYGVKRLEDFDASLKDALLKYIYDNRGTLIGQVDRLKDKVNNTLSTDIPFQLSKYVDNQRLLST

44. Protein sequence of the CP-qGHRH-LHC fusion
PITINNFNYSDPVDNKNILYLDTHLNTLANEPEKAFRITGNIWVIPDRFSRNSNPNLNKPPRVTSPKSGYY

DPNYLSTDSDKDTFLKEIIKLFKRINSREIGEELIYRLSTDIPFPGNNNTPINTFDFDVDFNSVDVKTRQG

-continued

| SEQ IDs |
|---|
| NNWVKTGSINPSVIITGPRENIIDPETSTFKLTNNTFAAQEGFGALSIISISPRFMLTYSNATNDVGEGRF<br>SKSEFCMDPILILMHELNHAMHNLYGIAIPNDQTISSVTSNIFYSQYNVKLEYAEIYAFGGPTIDLIPKSA<br>RKYFEEKALDYYRSIAKRLNSITTANPSSFNKYIGEYKQKLIRKYRFVVESSGEVTVNRNKFVELYNELTQ<br>IFTEFNYAKIYNVQNRKIYLSNVYTPVTANILDDNVYDIQNGFNIPKSNLNVLFMGQNLSRNPALRKVNPE<br>NMLYLFTKFCVDAIDGRHVDAIFTQSYRKVLAQLSARKLLQDILNRQQGERNQEQGALAGGGGSGGGGSGG<br>GGSALVLQCRELLVKNTDLPFIGDISDVKTDIFLRKDINEETEVIYYPDNVSVDQVILSKNTSEHGQLDLL<br>YPSIDSESEILPGENQVFYDNRTQNVDYLNSYYYLESQKLSDNVEDFTFTRSIEEALDNSAKVYTYFPTLA<br>NKVNAGVQGGLFLMWANDVVEDFTTNILRKDTLDKISDVSAIIPYIGPALNISNSVRRGNFTEAFAVTGVT<br>ILLEAFPEFTIPALGAFVIYSKVQERNEIIKTIDNCLEQRIKRWKDSYEWMMGTWLSRIITQFNNISYQMY<br>DSLNYQAGAIKAKIDLEYKKYSGSDKENIKSQVENLKNSLDVKISEAMNNINKFIRECSVTYLFKNMLPKV<br>IDELNEFDRNTKAKLINLIDSHNIILVGEVDKLKAKVNNSFQNTIPFNIFSYTNNSLLKDIINEYFN |
| 45. Protein sequence of the CP-qGHRH-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKHVDAIFTQSYRKVLAQLSARKLLQDILNRQQGERNQEQGAALAGG<br>GGSGGGGSGGGGSALALQCIKVKNNRLPYVADKDSISQEIFENKIITDETNVQNYSDKFSLDESILDGQVP<br>INPEIVDPLLPNVNMEPLNLPGEEIVFYDDITKYVDYLNSYYYLESQKLSNNVENITLTTSVEEALGYSNK<br>IYTFLPSLAEKVNKGVQAGLFLNWANEVVEDFTTNIMKKDTLDKISDVSVIIPYIGPALNIGNSALRGNFN<br>QAFATAGVAFLLEGFPEFTIPALGVFTFYSSIQEREKIIKTIENCLEQRVKRWKDSYQWMVSNWLSRITTQ<br>FNHINYQMYDSLSYQADAIKAKIDLEYKKYSGSDKENIKSQVENLKNSLDVKISEAMNNINKFIRECSVTY<br>LFKNMLPKVIDELNKFDLRTKTELINLIDSHNIILVGEVDRLKAKVNESFENTMPFNIFSYTNNSLLKDII<br>NEYFN |
| 46. Protein sequence of the CP-qGHRH-LHD N10-PL5 fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDNNNNNNNNNNDDDDKHVDAIFTQSYRKVLAQLSARKLLQDILNRQQGERNQEQGAPAPA<br>PLQCIKVKNNRLPYVADKDSISQEIFENKIITDETNVQNYSDKFSLDESILDGQVPINPEIVDPLLPNVNM<br>EPLNLPGEEIVFYDDITKYVDYLNSYYYLESQKLSNNVENITLTTSVEEALGYSNKIYTFLPSLAEKVNKG<br>VQAGLFLNWANEVVEDFTTNIMKKDTLDKISDVSVIIPYIGPALNIGNSALRGNFNQAFATAGVAFLLEGF<br>PEFTIPALGVFTFYSSIQEREKIIKTIENCLEQRVKRWKDSYQWMVSNWLSRITTQFNHINYQMYDSLSYQ<br>ADAIKAKIDLEYKKYSGSDKENIKSQVENLKNSLDVKISEAMNNINKFIRECSVTYLFKNMLPKVIDELNK |

-continued

| SEQ IDs |
|---|
| FDLRTKTELINLIDSHNIILVGEVDRLKAKVNESFENTMPFNIFSYTNNSLLKDIINEYFN |

47. Protein sequence of the CP-qGHRH-LHD N10-HX12 fusion
TWPVKDFNYSDPVNDNDILYLRIPQNKLITTPVKAFMITQNIWVIPERFSSDTNPSLSKPPRPTSKYQSYYDP

SYLSTDEQKDTFLKGIIKLFKRINERDIGKKLINYLVVGSPFMGDSSTPEDTFDFTRHTTNIAVEKFENGSWK

VTNIITPSVLIFGPLPNILDYTASLTLQGQQSNPSFEGFGTLSILKVAPEFLLTFSDVTSNQSSAVLGKSIFC

MDPVIALMHELTHSLHQLYGINIPSDKRIRPQVSEGFFSQDGPNVQFEELYTFGGLDVEIIPQIERSQLREKA

LGHYKDIAKRLNNINKTIPSSWISNIDKYKKIFSEKYNFDKDNTGNFVVNIDKFNSLYSDLTNVMSEVVYSSQ

YNVKNRTHYFSRHYLPVFANILDDNIYTIRDGFNLTNKGFNIENSGQNIERNPALQKLSSESVVDLFTKVCVD

NNNNNNNNNNDDDDKHVDAIFTQSYRKVLAQLSARKLLQDILNRQQGERNQEQGAEAAAKEAAAKALQCIKVK

NNRLPYVADKDSISQEIFENKIITDETNVQNYSDKFSLDESILDGQVPINPEIVDPLLPNVNMEPLNLPGEEI

VFYDDITKYVDYLNSYYYLESQKLSNNVENITLTTSVEEALGYSNKIYTFLPSLAEKVNKGVQAGLFLNWANE

VVEDFTTNIMKKDTLDKISDVSVIIPYIGPALNIGNSALRGNFNQAFATAGVAFLLEGFPEFTIPALGVFTFY

SSIQEREKIIKTIENCLEQRVKRWKDSYQWMVSNWLSRITTQFNHINYQMYDSLSYQADAIKAKIDLEYKKYS

GSDKENIKSQVENLKNSLDVKISEAMNNINKFIRECSVTYLFKNMLPKVIDELNKFDLRTKTELINLIDSHNI

ILVGEVDRLKAKVNESFENTMPFNIFSYTNNSLLKDIINEYFN

48. Protein sequence of the CP-UTS-LHA fusion
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECKSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGGGGSADDDDKNDDPPISIDLTFHLLRNMIEMARIENEREQAGLNRKYLDEVALAGGGGSGGGGSG

GGGSALVLQCIKVNNWDLFFSPSEDNFTNDLNKGEEITSDTNIEAAEENISLDLIQQYYLTFNFDNEPENI

SIENLSSDIIGQLELMPNIERFPNGKKYELDKYTMFHYLRAQEFEHGKSRIALTNSVNEALLNPSRVYTFF

SSDYVKKVNKATEAAMFLGWVEQLVYDFTDETSEVSTTDKIADITIIIPYIGPALNIGNMLYKDDFVGALI

FSGAVILLEFIPEIAIPVLGTFALVSYIANKVLTVQTIDNALSKRNEKWDEVYKYIVTNWLAKVNTQIDLI

RKKMKEALENQAEATKAIINYQYNQYTEEEKNNINFNIDDLSSKLNESINKAMININKFLNQCSVSYLMNS

MIPYGVKRLEDFDASLKDALLKYIYDNRGTLIGQVDRLKDKVNNTLSTDIPFQLSKYVDNQRLLST

49. Protein sequence of $LH_N$/A
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECKSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGIITSKTKSDDDDKNKALNLQCIKVNNWDLFFSPSEDNFTNDLNKGEEITSDTNIEAAEENISLDL

IQQYYLTFNFDNEPENISIENLSSDIIGQLELMPNIERFPNGKKYELDKYTMFHYLRAQEFEHGKSRIALT

NSVNEALLNPSRVYTFFSSDYVKKVNKATEAAMFLGWVEQLVYDFTDETSEVSTTDKIADITIIIPYIGPA

LNIGNMLYKDDFVGALIFSGAVILLEFIPEIAIPVLGTFALVSYIANKVLTVQTIDNALSKRNEKWDEVYK

-continued

| SEQ IDs |
|---|
| YIVTNWLAKVNTQIDLIRKKMKEALENQAEATKAIINYQYNQYTEEEKNNINFNIDDLSSKLNESINKAMI |
| NINKFLNQCSVSYLMNSMIPYGVKRLEDFDASLKDALLKYIYDNRGTLIGQVDRLKDKVNNTLSTDIPFQL |
| SKYVDNQRLLST |
| 50. Protein sequence of $LH_N$/B<br>PVTINNFNYNDPIDNNNIIMMEPPFARGTGRYYKAFKITDRIWIIPERYTFGYKPEDFNKSSGIFNRDVCE |
| YYDPDYLNTNDKKNIFLQTMIKLFNRIKSKPLGEKLLEMIINGIPYLGDRRVPLEEFNTNIASVTVNKLIS |
| NPGEVERKKGIFANLIIFGPGPVLNENETIDIGIQNHFASREGFGGIMQMKFCPEYVSVFNNVQENKGASI |
| FNRRGYFSDPALILMHELIHVLHGLYGIKVDDLPIVPNEKKFFMQSTDAIQAEELYTFGGQDPSIITPSTD |
| KSIYDKVLQNFRGIVDRLNKVLVCISDPNININIYKNKFKDKYKFVEDSEGKYSIDVESFDKLYKSLMFGF |
| TETNIAENYKIKTRASYFSDSLPPVKIKNLLDNEIYTIEEGFNISDKDMEKEYRGQNKAINKQAYEEISKE |
| HLAVYKIQMCVDEEKLYDDDDKDRWGSSLQCIDVDNEDLFFIADKNSFSDDLSKNERIEYNTQSNYIENDF |
| PINELILDTDLISKIELPSENTESLTDFNVDVPVYEKQPAIKKIFTDENTIFQYLYSQTFPLDIRDISLTS |
| SFDDALLFSNKVYSFFSMDYIKTANKVVEAGLFAGWVKQIVNDFVIEANKSNTMDAIADISLIVPYIGLAL |
| NVGNETAKGNFENAFEIAGASILLEFIPELLIPVVGAFLLESYIDNKNKIIKTIDNALTKRNEKWSDMYGL |
| IVAQWLSTVNTQFYTIKEGMYKALNYQAQALEEIIKYRYNIYSEKEKSNINIDFNDINSKLNEGINQAIDN |
| INNFINGCSVSYLMKKMIPLAVEKLLDFDNTLKKNLLNYIDENKLYLIGSAEYEKSKVNKYLKTIMPFDLS |
| IYTNDTILIEMFNKYNS |
| 51. Protein sequence of $LH_N$/C<br>PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDAIDGRSLYNKTLQCRELLVKNTDLPFIGDISDVKTDIFLRKDINEETEVIYYPDNVSVD |
| QVILSKNTSEHGQLDLLYPSIDSESEILPGENQVFYDNRTQNVDYLNSYYYLESQKLSDNVEDFTFTRSIE |
| EALDNSAKVYTYFPTLANKVNAGVQGGLFLMWANDVVEDFTTNILRKDTLDKISDVSAIIPYIGPALNISN |
| SVRRGNFTEAFAVTGVTILLEAFPEFTIPALGAFVIYSKVQERNEIIKTIDNCLEQRIKRWKDSYEWMMGT |
| WLSRIITQFNNISYQMYDSLNYQAGAIKAKIDLEYKKYSGSDKENIKSQVENLKNSLDVKISEAMNNINKF |
| IRECSVTYLFKNMLPKVIDELNEFDRNTKAKLINLIDSHNIILVGEVDKLKAKVNNSFQNTIPFNIFSYTN |
| NSLLKDIINEYFN |
| 52. Protein sequence of $LH_N$/D<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDKSEEKLYDDDDKDRWGSSLQCIKVKNNRLPYVADKDSISQEIFENKIITDETNVQNYSD |
| KFSLDESILDGQVPINPEIVDPLLPNVNMEPLNLPGEEIVFYDDITKYVDYLNSYYYLESQKLSNNVENIT |

-continued

| SEQ IDs |
| --- |
| LTTSVEEALGYSNKIYTFLPSLAEKVNKGVQAGLFLNWANEVVEDFTTNIMKKDTLDKISDVSVIIPYIGP |
| ALNIGNSALRGNFNQAFATAGVAFLLEGFPEFTIPALGVFTFYSSIQEREKIIKTIENCLEQRVKRWKDSY |
| QWMVSNWLSRITTQFNHINYQMYDSLSYQADAIKAKIDLEYKKYSGSDKENIKSQVENLKNSLDVKISEAM |
| NNINKFIRECSVTYLFKNMLPKVIDELNKFDLRTKTELINLIDSHNIILVGEVDRLKAKVNESFENTMPFN |
| IFSYTNNSLLKDIINEYFN |
| 53. Protein sequence of IgA-$H_N$tet<br>ESNQPEKNGTATKPENSGNTTSENGQTEPEKKLELRNVSDIELYSQTNGTYRQHVSLDGIPENTDTYFVKV |
| KSSAFKDVYIPVASITEEKRNGQSVYKITAKAEKLQQELENKYVDNFTFYLDKKAKEENTNFTSFSNLVKA |
| INQNPSGTYHLAASLNANEVELGPDERSYIKDTFTGRLIGEKDGKNYAIYNLKKPLFENLSGATVEKLSLK |
| NVAISGKNDIGSLANEATNGTKIKQVHVDGCVDGIITSKTKSDDDDKNKALNLQCIKIKNEDLTFIAEKNS |
| FSEEPFQDEIVSYNTKNKPLNFNYSLDKIIVDYNLQSKITLPNDRTTPVTKGIPYAPEYKSNAASTIEIHN |
| IDDNTIYQYLYAQKSPTTLQRITMTNSVDDALINSTKIYSYFPSVISKVNQGAQGILFLQWVRDIIDDFTN |
| ESSQKTTIDKISDVSTIVPYIGPALNIVKQGYEGNFIGALETTGVVLLLEYIPEITLPVIAALSIAESSTQ |
| KEKIIKTIDNFLEKRYEKWIEVYKLVKAKWLGTVNTQFQKRSYQMYRSLEYQVDAIKKIIDYEYKIYSGPD |
| KEQIADEINNLKNKLEEKANKAMININIFMRESSRSFLVNQMINEAKKQLLEFDTQSKNILMQYIKANSKF |
| IGITELKKLESKINKVFSTPIPFSYSKNLDCWVDNEEDIDV |
| 54. Synthesised Octreotide peptide<br>Cys-Dphe-Cys-Phe-Dtrp-Lys-Thr-Cys-Thr-ol |
| 55. Synthesised GHRH agonist peptide<br>HIS-ALA-ASP-ALA-ILE-PHE-THR-ASN-SER-TYR-ARG-LYS-VAL-LEU-GLY-GLN-LEU- |
| SER-ALA-ARG-LYS-LEU-LEU-GLN-ASP-ILE-NLE-SER-ARG-CYS |
| 56. Synthesised GHRH antagonist peptide<br>PhAc-Tyr-D-Arg-Asp-Ala-Ile-Phe(4-Cl)-Thr-Ala-Har-Tyr(Me)-His-Lys-Val- |
| Leu-Abu-Gln-Leu-Ser-Ala-His-Lys-Leu-Leu-Gln-Asp-Ile-Nle-D-Arg-Har-CYS |
| 57. Protein sequence of CP-MCH-LHD<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKDFDMLRCMLGRVYRPCWQVALAKRLVLQCIKVKNNRLPYVADKDS |
| ISQEIFENKIITDETNVQNYSDKFSLDESILDGQVPINPEIVDPLLPNVNMEPLNLPGEEIVFYDDITKYV |
| DYLNSYYYLESQKLSNNVENITLTTSVEEALGYSNKIYTFLPSLAEKVNKGVQAGLFLNWANEVVEDFTTN |
| IMKKDTLDKISDVSVIIPYIGPALNIGNSALRGNFNQAFATAGVAFLLEGFPEFTIPALGVFTFYSSIQER |
| EKIIKTIENCLEQRVKRWKDSYQWMVSNWLSRITTQFNHINYQMYDSLSYQADAIKAKIDLEYKKYSGSDK |
| ENIKSQVENLKNSLDVKISEAMNNINKFIRECSVTYLFKNMLPKVIDELNKFDLRTKTELINLIDSHNIIL |
| VGEVDRLKAKVNESFENTMPFNIFSYTNNSLLKDIINEYFN |
| 58. Protein sequence of CT-KISS-LHD<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |

-continued

| SEQ IDs |
|---|

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDKSEEKLYDDDDKDRWGSSLQCIKVKNNRLPYVADKDSISQEIFENKIITDETNVQNYSD

KFSLDESILDGQVPINPEIVDPLLPNVNMEPLNLPGEEIVFYDDITKYVDYLNSYYYLESQKLSNNVENIT

LTTSVEEALGYSNKIYTFLPSLAEKVNKGVQAGLFLNWANEVVEDFTTNIMKKDTLDKISDVSVIIPYIGP

ALNIGNSALRGNFNQAFATAGVAFLLEGFPEFTIPALGVFTFYSSIQEREKIIKTIENCLEQRVKRWKDSY

QWMVSNWLSRITTQFNHINYQMYDSLSYQADAIKAKIDLEYKKYSGSDKENIKSQVENLKNSLDVKISEAM

NNINKFIRECSVTYLFKNMLPKVIDELNKFDLRTKTELINLIDSHNIILVGEVDRLKAKVNESFENTMPFN

IFSYTNNSLLKDIINEYFNLEGGGGSGGGGSGGGGSALVYNWNSFGLRFG

59. Protein sequence of CT-PrRP-LHA
EFVNKQFNYKDPVNGVDIAYIKIPNAGQMQPVKAFKIHNKIWVIPERDTFTNPEEGDLNPPPEAKQVPVSY

YDSTYLSTDNEKDNYLKGVTKLFERIYSTDLGRMLLTSIVRGIPFWGGSTIDTELKVIDTNCINVIQPDGS

YRSEELNLVIIGPSADIIQFECKSFGHEVLNLTRNGYGSTQYIRFSPDFTFGFEESLEVDTNPLLGAGKFA

TDPAVTLAHELIHAGHRLYGIAINPNRVFKVNTNAYYEMSGLEVSFEELRTFGGHDAKFIDSLQENEFRLY

YYNKFKDIASTLNKAKSIVGTTASLQYMKNVFKEKYLLSEDTSGKFSVDKLKFDKLYKMLTEIYTEDNFVK

FFKVLNRKTYLNFDKAVFKINIVPKVNYTIYDGFNLRNTNLAANFNGQNTEINNMNFTKLKNFTGLFEFYK

LLCVDGIITSKTKSDDDDKNKALNLQCIKVNNWDLFFSPSEDNFTNDLNKGEEITSDTNIEAAEENISLDL

IQQYYLTFNFDNEPENISIENLSSDIIGQLELMPNIERFPNGKKYELDKYTMFHYLRAQEFEHGKSRIALT

NSVNEALLNPSRVYTFFSSDYVKKVNKATEAAMFLGWVEQLVYDFTDETSEVSTTDKIADITIIIPYIGPA

LNIGNMLYKDDFVGALIFSGAVILLEFIPEIAIPVLGTFALVSYIANKVLTVQTIDNALSKRNEKWDEVYK

YIVTNWLAKVNTQIDLIRKKMKEALENQAEATKAIINYQYNQYTEEEKNNINFNIDDLSSKLNESINKAMI

NINKFLNQCSVSYLMNSMIPYGVKRLEDFDASLKDALLKYIYDNRGTLIGQVDRLKDKVNNTLSTDIPFQL

SKYVDNQRLLSTLEGGGGSGGGGSGGGGSALVTPDINPAWYASRGIRPVGRFG

60. Protein sequence of CP-HS_GHRH_1-27-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKYADAIFTNSYRKVLGQLSARKLLQDIMALAGGGGSGGGGSGGGGS

ALALQCIKVKNNRLPYVADKDSISQEIFENKIITDETNVQNYSDKFSLDESILDGQVPINPEIVDPLLPNV

NMEPLNLPGEEIVFYDDITKYVDYLNSYYYLESQKLSNNVENITLTTSVEEALGYSNKIYTFLPSLAEKVN

KGVQAGLFLNWANEVVEDFTTNIMKKDTLDKISDVSVIIPYIGPALNIGNSALRGNFNQAFATAGVAFLLE

GFPEFTIPALGVFTFYSSIQEREKIIKTIENCLEQRVKRWKDSYQWMVSNWLSRITTQFNHINYQMYDSLS

YQADAIKAKIDLEYKKYSGSDKENIKSQVENLKNSLDVKISEAMNNINKFIRECSVTYLFKNMLPKVIDEL

NKFDLRTKTELINLIDSHNIILVGEVDRLKAKVNESFENTMPFNIFSYTNNSLLKDIINEYFN

61. Protein sequence of the CP-HS_GHRH_1-28-LHD fusion
TWPVKDFNYSDPVNDNDILYLRIPQNKLITTPVKAFMITQNIWVIPERFSSDTNPSLSKPPRPTSKYQSYY -continued

| SEQ IDs |
|---|
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLGQLSARKLLQDIMSALAGGGGSGGGGSGGGG |
| SALALQCIKVKNNRLPYVADKDSISQEIFENKIITDETNVQNYSDKFSLDESILDGQVPINPEIVDPLLPN |
| VNMEPLNLPGEEIVFYDDITKYVDYLNSYYYLESQKLSNNVENITLTTSVEEALGYSNKIYTFLPSLAEKV |
| NKGVQAGLFLNWANEVVEDFTTNIMKKDTLDKISDVSVIIPYIGPALNIGNSALRGNFNQAFATAGVAFLL |
| EGFPEFTIPALGVFTFYSSIQEREKIIKTIENCLEQRVKRWKDSYQWMVSNWLSRITTQFNHINYQMYDSL |
| SYQADAIKAKIDLEYKKYSGSDKENIKSQVENLKNSLDVKISEAMNNINKFIRECSVTYLFKNMLPKVIDE |
| LNKFDLRTKTELINLIDSHNIILVGEVDRLKAKVNESFENTMPFNIFSYTNNSLLKDIINEYFN |
| 62. Protein sequence of the CP-HS_GHRH_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 63. Protein sequence of the CP-HS_GHRH_1-44-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLGQLSARKLLQDIMSRQQGESNQERGARARLA |
| LAGGGGSGGGGSGGGGSALALQCIKVKNNRLPYVADKDSISQEIFENKIITDETNVQNYSDKFSLDESILD |
| GQVPINPEIVDPLLPNVNMEPLNLPGEEIVFYDDITKYVDYLNSYYYLESQKLSNNVENITLTTSVEEALG |
| YSNKIYTFLPSLAEKVNKGVQAGLFLNWANEVVEDFTTNIMKKDTLDKISDVSVIIPYIGPALNIGNSALR |
| GNFNQAFATAGVAFLLEGFPEFTIPALGVFTFYSSIQEREKIIKTIENCLEQRVKRWKDSYQWMVSNWLSR |
| ITTQFNHINYQMYDSLSYQADAIKAKIDLEYKKYSGSDKENIKSQVENLKNSLDVKISEAMNNINKFIREC |

-continued

| SEQ IDs |
| --- |
| SVTYLFKNMLPKVIDELNKFDLRTKTELINLIDSHNIILVGEVDRLKAKVNESFENTMPFNIFSYTNNSLL |
| KDIINEYFN |
| 64. Protein sequence of the CP-HS_GHRH_1-40-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLGQLSARKLLQDIMSRQQGESNQERGALAGGG |
| GSGGGGSGGGGSALALQCIKVKNNRLPYVADKDSISQEIFENKIITDETNVQNYSDKFSLDESILDGQVPI |
| NPEIVDPLLPNVNMEPLNLPGEEIVFYDDITKYVDYLNSYYYLESQKLSNNVENITLTTSVEEALGYSNKI |
| YTFLPSLAEKVNKGVQAGLFLNWANEVVEDFTTNIMKKDTLDKISDVSVIIPYIGPALNIGNSALRGNFNQ |
| AFATAGVAFLLEGFPEFTIPALGVFTFYSSIQEREKIIKTIENCLEQRVKRWKDSYQWMVSNWLSRITTQF |
| NHINYQMYDSLSYQADAIKAKIDLEYKKYSGSDKENIKSQVENLKNSLDVKISEAMNNINKFIRECSVTYL |
| FKNMLPKVIDELNKFDLRTKTELINLIDSHNIILVGEVDRLKAKVNESFENTMPFNIFSYTNNSLLKDIIN |
| EYFN |
| 65. Protein sequence of the CP-HS_GHRH_Ala9-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNAYRKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 66. Protein sequence of the CP-HS_GHRH_Ala22-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLGQLSARKALQDIMSRALAGGGGSGGGGSGGG |
| GSALALQCIKVKNNRLPYVADKDSISQEIFENKIITDETNVQNYSDKFSLDESILDGQVPINPEIVDPLLP |

-continued

| SEQ IDs |
|---|
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 67. Protein sequence of the CP-HS_GHRH_Ala8_Lys11_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYKKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 68. Protein sequence of the CP-HS_GHRH_Ala8_Lys11_Arg12_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYKRVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 69. Protein sequence of the CP-HS_GHRH_Ala8_Asn11_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |

-continued

| SEQ IDs |
|---|
| SVVDLFTKVCVDGIITSKTKSDDDDKYADAIFTASYNKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 70. Protein sequence of the CP-HS_GHRH_Ala8_Lys20_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYRKVLGQLSAKKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 71. Protein sequence of the CP-HS_GHRH_Ala8_Lys11_Lys20_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYKKVLGQLSAKKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 72. Protein sequence of the CP-HS_GHRH_Ala8_Asn20_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |

-continued

| SEQ IDs |
|---|

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKYADAIFTASYRKVLGQLSANKLLQDIMSRALAGGGGSGGGGSGGG

GSALALQCIKVKNNRLPYVADKDSISQEIFENKIITDETNVQNYSDKFSLDESILDGQVPINPEIVDPLLP

NVNMEPLNLPGEEIVFYDDITKYVDYLNSYYYLESQKLSNNVENITLTTSVEEALGYSNKIYTFLPSLAEK

VNKGVQAGLFLNWANEVVEDFTTNIMKKDTLDKISDVSVIIPYIGPALNIGNSALRGNFNQAFATAGVAFL

LEGFPEFTIPALGVFTFYSSIQEREKIIKTIENCLEQRVKRWKDSYQWMVSNWLSRITTQFNHINYQMYDS

LSYQADAIKAKIDLEYKKYSGSDKENIKSQVENLKNSLDVKISEAMNNINKFIRECSVTYLFKNMLPKVID

ELNKFDLRTKTELINLIDSHNIILVGEVDRLKAKVNESFENTMPFNIFSYTNNSLLKDIINEYFN

73. Protein sequence of the CP-HS_GHRH_Ala8_Asn12_1-29-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKYADAIFTASYRNVLGQLSARKLLQDIMSRALAGGGGSGGGGSGGG

GSALALQCIKVKNNRLPYVADKDSISQEIFENKIITDETNVQNYSDKFSLDESILDGQVPINPEIVDPLLP

NVNMEPLNLPGEEIVFYDDITKYVDYLNSYYYLESQKLSNNVENITLTTSVEEALGYSNKIYTFLPSLAEK

VNKGVQAGLFLNWANEVVEDFTTNIMKKDTLDKISDVSVIIPYIGPALNIGNSALRGNFNQAFATAGVAFL

LEGFPEFTIPALGVFTFYSSIQEREKIIKTIENCLEQRVKRWKDSYQWMVSNWLSRITTQFNHINYQMYDS

LSYQADAIKAKIDLEYKKYSGSDKENIKSQVENLKNSLDVKISEAMNNINKFIRECSVTYLFKNMLPKVID

ELNKFDLRTKTELINLIDSHNIILVGEVDRLKAKVNESFENTMPFNIFSYTNNSLLKDIINEYFN

74. Protein sequence of the CP-HS_GHRH_Ala8_Asn21_1-29-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKYADAIFTASYRKVLGQLSARNLLQDIMSRALAGGGGSGGGGSGGG

GSALALQCIKVKNNRLPYVADKDSISQEIFENKIITDETNVQNYSDKFSLDESILDGQVPINPEIVDPLLP

NVNMEPLNLPGEEIVFYDDITKYVDYLNSYYYLESQKLSNNVENITLTTSVEEALGYSNKIYTFLPSLAEK

VNKGVQAGLFLNWANEVVEDFTTNIMKKDTLDKISDVSVIIPYIGPALNIGNSALRGNFNQAFATAGVAFL

LEGFPEFTIPALGVFTFYSSIQEREKIIKTIENCLEQRVKRWKDSYQWMVSNWLSRITTQFNHINYQMYDS

LSYQADAIKAKIDLEYKKYSGSDKENIKSQVENLKNSLDVKISEAMNNINKFIRECSVTYLFKNMLPKVID

ELNKFDLRTKTELINLIDSHNIILVGEVDRLKAKVNESFENTMPFNIFSYTNNSLLKDIINEYFN

75. Protein sequence of the CP-HS_GHRH_Ala8_Glu_7_1-29-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

-continued

| SEQ IDs |
|---|
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFEASYRKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 76. Protein sequence of the CP-HS_GHRH_Ala8_Glu_10_1-29LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASERKVLGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 77. Protein sequence of the CP-HS_GHRH_Ala8_Glu_13_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYRKELGQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |

-continued

| SEQ IDs |
| --- |
| 78. Protein sequence of the CP-HS_GHRH_Ala8-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKYADAIFTASYRKVLGQLSARKLLQDIMSRALAGGGGSGGGGSGGG<br>GSALALQCIKVKNNRLPYVADKDSISQEIFENKIITDETNVQNYSDKFSLDESILDGQVPINPEIVDPLLP<br>NVNMEPLNLPGEEIVFYDDITKYVDYLNSYYYLESQKLSNNVENITLTTSVEEALGYSNKIYTFLPSLAEK<br>VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYFN |
| 79. Protein sequence of the CP-HS_GHRH_Glu8_1-29-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKYADAIFTESYRKVLGQLSARKLLQDIMSRALAGGGGSGGGGSGGG<br>GSALALQCIKVKNNRLPYVADKDSISQEIFENKIITDETNVQNYSDKFSLDESILDGQVPINPEIVDPLLP<br>NVNMEPLNLPGEEIVFYDDITKYVDYLNSYYYLESQKLSNNVENITLTTSVEEALGYSNKIYTFLPSLAEK<br>VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYFN |
| 80. Protein sequence of the CP-HS_GHRH_Ala15_1-27-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKYADAIFTNSYRKVLAQLSARKLLQDIMALAGGGGSGGGGSGGGGS<br>ALALQCIKVKNNRLPYVADKDSISQEIFENKIITDETNVQNYSDKFSLDESILDGQVPINPEIVDPLLPNV<br>NMEPLNLPGEEIVFYDDITKYVDYLNSYYYLESQKLSNNVENITLTTSVEEALGYSNKIYTFLPSLAEKVN<br>KGVQAGLFLNWANEVVEDFTTNIMKKDTLDKISDVSVIIPYIGPALNIGNSALRGNFNQAFATAGVAFLLE<br>GFPEFTIPALGVFTFYSSIQEREKIIKTIENCLEQRVKRWKDSYQWMVSNWLSRITTQFNHINYQMYDSLS |

-continued

| SEQ IDs |
| --- |
| YQADAIKAKIDLEYKKYSGSDKENIKSQVENLKNSLDVKISEAMNNINKFIRECSVTYLFKNMLPKVIDEL |
| NKFDLRTKTELINLIDSHNIILVGEVDRLKAKVNESFENTMPFNIFSYTNNSLLKDIINEYFN |
| 81. Protein sequence of the CP-HS_GHRH_Ala15-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTNSYRKVLAQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 82. Protein sequence of the CP-HS_GHRH_Ala8_Ala15_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTASYRKVLAQLSARKLLQDIMSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 83. Protein sequence of the CP-HS_GHRH_Ala8_9_15_22_27-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTAAYRKVLAQLSARKALQDIASRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |

-continued

| SEQ IDs |
| --- |
| VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYFN |
| 84. Protein sequence of the CP-HS_GHRH_Ala8_9_15_22-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKYADAIFTAAYRKVLAQLSARKALQDIMSRALAGGGGSGGGGSGGG<br>GSALALQCIKVKNNRLPYVADKDSISQEIFENKIITDETNVQNYSDKFSLDESILDGQVPINPEIVDPLLP<br>NVNMEPLNLPGEEIVFYDDITKYVDYLNSYYYLESQKLSNNVENITLTTSVEEALGYSNKIYTFLPSLAEK<br>VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYFN |
| 85. Protein sequence of the CP-HS_GHRH_HVQAL_1-32-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKHVDAIFTQSYRKVLAQLSARKALQDILSRQQGALAGGGGSGGGGS<br>GGGGSALALQCIKVKNNRLPYVADKDSISQEIFENKIITDETNVQNYSDKFSLDESILDGQVPINPEIVDP<br>LLPNVNMEPLNLPGEEIVFYDDITKYVDYLNSYYYLESQKLSNNVENITLTTSVEEALGYSNKIYTFLPSL<br>AEKVNKGVQAGLFLNWANEVVEDFTTNIMKKDTLDKISDVSVIIPYIGPALNIGNSALRGNFNQAFATAGV<br>AFLLEGFPEFTIPALGVFTFYSSIQEREKIIKTIENCLEQRVKRWKDSYQWMVSNWLSRITTQFNHINYQM<br>YDSLSYQADAIKAKIDLEYKKYSGSDKENIKSQVENLKNSLDVKISEAMNNINKFIRECSVTYLFKNMLPK<br>VIDELNKFDLRTKTELINLIDSHNIILVGEVDRLKAKVNESFENTMPFNIFSYTNNSLLKDIINEYFN |
| 86. Protein sequence of the CP-HS_GHRH_HVSAL_1-29-LHD fusion<br>TWPVKDFNYSDPVNDNDILYLRIPQNKLITTPVKAFMITQNIWVIPERFSSDTNPSLSKPPRPTSKYQSYY<br>DPSYLSTDEQKDTFLKGIIKLFKRINERDIGKKLINYLVVGSPFMGDSSTPEDTFDFTRHTTNIAVEKFEN<br>GSWKVTNIITPSVLIFGPLPNILDYTASLTLQGQQSNPSFEGFGTLSILKVAPEFLLTFSDVTSNQSSAVL<br>GKSIFCMDPVIALMHELTHSLHQLYGINIPSDKRIRPQVSEGFFSQDGPNVQFEELYTFGGLDVEIIPQIE<br>RSQLREKALGHYKDIAKRLNNINKTIPSSWISNIDKYKKIFSEKYNFDKDNTGNFVVNIDKFNSLYSDLTN<br>VMSEVVYSSQYNVKNRTHYFSRHYLPVFANILDDNIYTIRDGFNLTNKGFNIENSGQNIERNPALQKLSSE<br>SVVDLFTKVCVDGIITSKTKSDDDDKHVDAIFTSSYRKVLAQLSARKLLQDILSRALAGGGGSGGGGSGGG |

-continued

| SEQ IDs |
| --- |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 87. Protein sequence of the CP-HS_GHRH_HVTAL_1-29-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKHVDAIFTTSYRKVLAQLSARKLLQDILSRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 88. Protein sequence of the CP-HS_GHRH_QALN-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDGIITSKTKSDDDDKYADAIFTQSYRKVLAQLSARKALQDILNRALAGGGGSGGGGSGGG |
| GSALALQCIKVKNNRLPYVADKDSISQEIFENKIITDETNVQNYSDKFSLDESILDGQVPINPEIVDPLLP |
| NVNMEPLNLPGEEIVFYDDITKYVDYLNSYYYLESQKLSNNVENITLTTSVEEALGYSNKIYTFLPSLAEK |
| VNKGVQAGLFLNWANEVVEDFTTNIMKKDTLDKISDVSVIIPYIGPALNIGNSALRGNFNQAFATAGVAFL |
| LEGFPEFTIPALGVFTFYSSIQEREKIIKTIENCLEQRVKRWKDSYQWMVSNWLSRITTQFNHINYQMYDS |
| LSYQADAIKAKIDLEYKKYSGSDKENIKSQVENLKNSLDVKISEAMNNINKFIRECSVTYLFKNMLPKVID |
| ELNKFDLRTKTELINLIDSHNIILVGEVDRLKAKVNESFENTMPFNIFSYTNNSLLKDIINEYFN |
| 89. Protein sequence of the CP-HS_GHRH_QAL-LHD fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |

-continued

| SEQ IDs |
| --- |

VMSEVVYSSQYNVKNRTHYFSRHYLPVFANILDDNIYTIRDGFNLTNKGFNIENSGQNIERNPALQKLSSE

SVVDLFTKVCVDGIITSKTKSDDDDKYADAIFTQSYRKVLAQLSARKALQDILSRALAGGGGSGGGGSGGG

GSALALQCIKVKNNRLPYVADKDSISQEIFENKIITDETNVQNYSDKFSLDESILDGQVPINPEIVDPLLP

NVNMEPLNLPGEEIVFYDDITKYVDYLNSYYYLESQKLSNNVENITLTTSVEEALGYSNKIYTFLPSLAEK

VNKGVQAGLFLNWANEVVEDFTTNIMKKDTLDKISDVSVIIPYIGPALNIGNSALRGNFNQAFATAGVAFL

LEGFPEFTIPALGVFTFYSSIQEREKIIKTIENCLEQRVKRWKDSYQWMVSNWLSRITTQFNHINYQMYDS

LSYQADAIKAKIDLEYKKYSGSDKENIKSQVENLKNSLDVKISEAMNNINKFIRECSVTYLFKNMLPKVID

ELNKFDLRTKTELINLIDSHNIILVGEVDRLKAKVNESFENTMPFNIFSYTNNSLLKDIINEYFN

90. Protein sequence of the CP-hGHRH29 N8A M27L-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSIEGRYADAIFTASYRKVLGQLSARKLLQDILSR

ALAGGGGSGGGGSGGGGSALALQCIKVKNNRLPYVADKDSISQEIFENKIITDETNVQNYSDKFSLDESIL

DGQVPINPEIVDPLLPNVNMEPLNLPGEEIVFYDDITKYVDYLNSYYYLESQKLSNNVENITLTTSVEEAL

GYSNKIYTFLPSLAEKVNKGVQAGLFLNWANEVVEDFTTNIMKKDTLDKISDVSVIIPYIGPALNIGNSAL

RGNFNQAFATAGVAFLLEGFPEFTIPALGVFTFYSSIQEREKIIKTIENCLEQRVKRWKDSYQWMVSNWLS

RITTQFNHINYQMYDSLSYQADAIKAKIDLEYKKYSGSDKENIKSQVENLKNSLDVKISEAMNNINKFIRE

CSVTYLFKNMLPKVIDELNKFDLRTKTELINLIDSHNIILVGEVDRLKAKVNESFENTMPFNIFSYTNNSL

LKDIINEYFN

91. Protein sequence of the CP-hGHRH29 N8A K12N M27L-LHD fusion
TWPVKDFNYSDPVNDNDILYLRIPQNKLITTPVKAFMITQNIWVIPERFSSDTNPSLSKPPRPTSKYQSYY

DPSYLSTDEQKDTFLKGIIKLFKRINERDIGKKLINYLVVGSPFMGDSSTPEDTFDFTRHTTNIAVEKFEN

GSWKVTNIITPSVLIFGPLPNILDYTASLTLQGQQSNPSFEGFGTLSILKVAPEFLLTFSDVTSNQSSAVL

GKSIFCMDPVIALMHELTHSLHQLYGINIPSDKRIRPQVSEGFFSQDGPNVQFEELYTFGGLDVEIIPQIE

RSQLREKALGHYKDIAKRLNNINKTIPSSWISNIDKYKKIFSEKYNFDKDNTGNFVVNIDKFNSLYSDLTN

VMSEVVYSSQYNVKNRTHYFSRHYLPVFANILDDNIYTIRDGFNLTNKGFNIENSGQNIERNPALQKLSSE

SVVDLFTKVCVDGIITSKTKSIEGR YADAIFTASYRNVLGQLSARKLLQDILSR

ALAGGGGSGGGGSGGGGSALALQCIKVKNNRLPYVADKDSISQEIFENKIITDETNVQNYSDKFSLDESIL

DGQVPINPEIVDPLLPNVNMEPLNLPGEEIVFYDDITKYVDYLNSYYYLESQKLSNNVENITLTTSVEEAL

GYSNKIYTFLPSLAEKVNKGVQAGLFLNWANEVVEDFTTNIMKKDTLDKISDVSVIIPYIGPALNIGNSAL

RGNFNQAFATAGVAFLLEGFPEFTIPALGVFTFYSSIQEREKIIKTIENCLEQRVKRWKDSYQWMVSNWLS

RITTQFNHINYQMYDSLSYQADAIKAKIDLEYKKYSGSDKENIKSQVENLKNSLDVKISEAMNNINKFIRE

CSVTYLFKNMLPKVIDELNKFDLRTKTELINLIDSHNIILVGEVDRLKAKVNESFENTMPFNIFSYTNNSL

LKDIINEYFN

92. Protein sequence of the N-termianal-hGHRH29 N8A M27L-LHD fusion
HVDAIFTQSYRKVLAQLSARKLLQDILNRNNNNNNNNNNTWPVKDFNYSDPVNDNDILYLRIPQNKLITTP -continued

| SEQ IDs |
|---|
| VKAFMITQNIWVIPERFSSDTNPSLSKPPRPTSKYQSYYDPSYLSTDEQKDTFLKGIIKLFKRINERDIGK |
| KLINYLVVGSPFMGDSSTPEDTFDFTRHTTNIAVEKFENGSWKVTNIITPSVLIFGPLPNILDYTASLTLQ |
| GQQSNPSFEGFGTLSILKVAPEFLLTFSDVTSNQSSAVLGKSIFCMDPVIALMHELTHSLHQLYGINIPSD |
| KRIRPQVSEGFFSQDGPNVQFEELYTFGGLDVEIIPQIERSQLREKALGHYKDIAKRLNNINKTIPSSWIS |
| NIDKYKKIFSEKYNFDKDNTGNFVVNIDKFNSLYSDLTNVMSEVVYSSQYNVKNRTHYFSRHYLPVFANIL |
| DDNIYTIRDGFNLTNKGFNIENSGQNIERNPALQKLSSESVVDLFTKVCVDKSEEKLYDDDDKDRWGSSLQ |
| CIKVKNNRLPYVADKDSISQEIFENKIITDETNVQNYSDKFSLDESILDGQVPINPEIVDPLLPNVNMEPL |
| NLPGEEIVFYDDITKYVDYLNSYYYLESQKLSNNVENITLTTSVEEALGYSNKIYTFLPSLAEKVNKGVQA |
| GLFLNWANEVVEDFTTNIMKKDTLDKISDVSVIIPYIGPALNIGNSALRGNFNQAFATAGVAFLLEGFPEF |
| TIPALGVFTFYSSIQEREKIIKTIENCLEQRVKRWKDSYQWMVSNWLSRITTQFNHINYQMYDSLSYQADA |
| IKAKIDLEYKKYSGSDKENIKSQVENLKNSLDVKISEAMNNINKFIRECSVTYLFKNMLPKVIDELNKFDL |
| RTKTELINLIDSHNIILVGEVDRLKAKVNESFENTMPFNIFSYTNNSLLKDIINEYFN |
| SEQ ID 93 GnRH-C fusion protein<br>PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDAIDGRSLYNKTLQCRELLVKNTDLPFIGDISDVKTDIFLRKDINEETEVIYYPDNVSVD |
| QVILSKNTSEHGQLDLLYPSIDSESEILPGENQVFYDNRTQNVDYLNSYYYLESQKLSDNVEDFTFTRSIE |
| EALDNSAKVYTYFFTLANKVNAGVQGGLFLMWANDVVEDFTTNILRKDTLDKISDVSAIIPYIGPALNISN |
| SVRRGNFTEAFAVTGVTILLEAFPEFTIPALGAFVIYSKVQERNEIIKTIDNCLEQRIKRWKDSYEWMMGT |
| WLSRIITQFNNISYQMYDSLNYQAGAIKAKIDLEYKKYSGSDKENIKSQVENLKNSLDVKISEAMNNINKF |
| IRECSVTYLFKNMLPKVIDELNEFDRNTKAKLINLIDSHNIILVGEVDKLKAKVNNSFQNTIPFNIFSYTN |
| NSLLKDIINEYFNLEGGGGSGGGGSGGGGSALVMKPIQKLLAGLILLTWCVEGCSSQHWSYGLRPGGKRDA |
| ENLIDSFQEIVKEVGQLAETQRFECTTHQPRSPLRDLKGALESLIEEETGQKKI |
| SEQ ID 94 GnRH-D fusion<br>TWPVKDFNYSDPVNDNDILYLRIPQNKLITTPVKAFMITQNIWVIPERFSSDTNPSLSKPPRPTSKYQSYY |
| DPSYLSTDEQKDTFLKGIIKLFKRINERDIGKKLINYLVVGSPFMGDSSTPEDTFDFTRHTTNIAVEKFEN |
| GSWKVTNIITPSVLIFGPLPNILDYTASLTLQGQQSNPSFEGFGTLSILKVAPEFLLTFSDVTSNQSSAVL |
| GKSIFCMDPVIALMHELTHSLHQLYGINIPSDKRIRPQVSEGFFSQDGPNVQFEELYTFGGLDVEIIPQIE |
| RSQLREKALGHYKDIAKRLNNINKTIPSSWISNIDKYKKIFSEKYNFDKDNTGNFVVNIDKFNSLYSDLTN |
| VMSEVVYSSQYNVKNRTHYFSRHYLPVFANILDDNIYTIRDGFNLTNKGFNIENSGQNIERNPALQKLSSE |
| SVVDLFTKVCVDKSEEKLYDDDDKDRWGSSLQCIKVKNNRLPYVADKDSISQEIFENKIITDETNVQNYSD |
| KFSLDESILDGQVPINPEIVDPLLPNVNMEPLNLPGEEIVFYDDITKYVDYLNSYYYLESQKLSNNVENIT |
| LTTSVEEALGYSNKIYTFLPSLAEKVNKGVQAGLFLNWANEVVEDFTTNIMKKDTLDKISDVSVIIPYIGP |
| ALNIGNSALRGNFNQAFATAGVAFLLEGFPEFTIPALGVFTFYSSIQEREKIIKTIENCLEQRVKRWKDSY |
| QWMVSNWLSRITTQFNHINYQMYDSLSYQADAIKAKIDLEYKKYSGSDKENIKSQVENLKNSLDVKISEAM |
| NNINKFIRECSVTYLFKNMLPKVIDELNKFDLRTKTELINLIDSHNIILVGEVDRLKAKVNESFENTMPFN |

-continued

| SEQ IDs |
|---|
| IFSYTNNSLLKDIINEYFNLEGGGGSGGGGSGGGGSGGGGSALVMKPIQKLLAGLILLTWCVEGCSSQHWS<br>YGLRPGGKRDAENLIDSFQEIVKEVGQLAETQRFECTTHQPRSPLRDLKGALESLIEEETGQKKI |
| SEQ ID 95 Protein sequence LHD CP Human GHRH 1-40 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE<br>NGSWKVTNIITPSVLIFGPLPNILDYTASLTLQGQQSNPSFEGFGTLSILKVAPEFLLTFSDVTSNQSSAV<br>LGKSIFCMDPVIALMHELTHSLHQLYGINIPSDKRIRPQVSEGFFSQDGPNVQFEELYTFGGLDVEIIPQI<br>ERSQLREKALGHYKDIAKRLNNINKTIPSSWISNIDKYKKIFSEKYNFDKDNTGNFVVNIDKFNSLYSDLT<br>NVMSEVVYSSQYNVKNRTHYFSRHYLPVFANILDDNIYTIRDGFNLTNKGFNIENSGQNIERNPALQKLSS<br>ESVVDLFTKVCVDGIITSKTKSLIEGRYADAIFTNSYRKVLGQLSARKLLQDIMSRQQGESNQERGALAGG<br>GGSGGGGSGGGGSALVLQCIKVKNNRLPYVADKDSISQEIFENKIITDETNVQNYSDKFSLDESILDGQVP<br>INPEIVDPLLPNVNMEPLNLPGEEIVFYDDITKYVDYLNSYYYLESQKLSNNVENITLTTSVEEALGYSNK<br>IYTFLPSLAEKVNKGVQAGLFLNWANEVVEDFTTNIMKKDTLDKISDVSVIIPYIGPALNIGNSALRGNFN<br>QAFATAGVAFLLEGFPEFTIPALGVFTFYSSIQEREKIIKTIENCLEQRVKRWKDSYQWMVSNWLSRITTQ<br>FNHINYQMYDSLSYQADAIKAKIDLEYKKYSGSDKENIKSQVENLKNSLDVKISEAMNNINKFIRECSVTY<br>LFKNMLPKVIDELNKFDLRTKTELINLIDSHNIILVGEVDRLKAKVNESFENTMPFNIFSYTNNSLLKDII<br>NEYF |
| SEQ ID 96 Protein sequence LHD CP Human GHRH 1-44 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE<br>NGSWKVTNIITPSVLIFGPLPNILDYTASLTLQGQQSNPSFEGFGTLSILKVAPEFLLTFSDVTSNQSSAV<br>LGKSIFCMDPVIALMHELTHSLHQLYGINIPSDKRIRPQVSEGFFSQDGPNVQFEELYTFGGLDVEIIPQI<br>ERSQLREKALGHYKDIAKRLNNINKTIPSSWISNIDKYKKIFSEKYNFDKDNTGNFVVNIDKFNSLYSDLT<br>NVMSEVVYSSQYNVKNRTHYFSRHYLPVFANILDDNIYTIRDGFNLTNKGFNIENSGQNIERNPALQKLSS<br>ESVVDLFTKVCVDGIITSKTKSLIEGRYADAIFTNSYRKVLGQLSARKLLQDIMSRQQGESNQERGARARL<br>LAGGGGSGGGGSGGGGSALVLQCIKVKNNRLPYVADKDSISQEIFENKIITDETNVQNYSDKFSLDESILD<br>GQVPINPEIVDPLLPNVNMEPLNLPGEEIVFYDDITKYVDYLNSYYYLESQKLSNNVENITLTTSVEEALG<br>YSNKIYTFLPSLAEKVNKGVQAGLFLNWANEVVEDFTTNIMKKDTLDKISDVSVIIPYIGPALNIGNSALR<br>GNFNQAFATAGVAFLLEGFPEFTIPALGVFTFYSSIQEREKIIKTIENCLEQRVKRWKDSYQWMVSNWLSR<br>ITTQFNHINYQMYDSLSYQADAIKAKIDLEYKKYSGSDKENIKSQVENLKNSLDVKISEAMNNINKFIREC<br>SVTYLFKNMLPKVIDELNKFDLRTKTELINLIDSHNIILVGEVDRLKAKVNESFENTMPFNIFSYTNNSLL<br>KDIINEYF |
| SEQ ID 97 Protein sequence LHD CP Human GHRH 1-29 Arg substituted at<br>position 9 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE<br>NGSWKVTNIITPSVLIFGPLPNILDYTASLTLQGQQSNPSFEGFGTLSILKVAPEFLLTFSDVTSNQSSAV<br>LGKSIFCMDPVIALMHELTHSLHQLYGINIPSDKRIRPQVSEGFFSQDGPNVQFEELYTFGGLDVEIIPQI<br>ERSQLREKALGHYKDIAKRLNNINKTIPSSWISNIDKYKKIFSEKYNFDKDNTGNFVVNIDKFNSLYSDLT<br>NVMSEVVYSSQYNVKNRTHYFSRHYLPVFANILDDNIYTIRDGFNLTNKGFNIENSGQNIERNPALQKLSS |

-continued

| SEQ IDs |
|---|
| ESVVDLFTKVCVDGIITSKTKSLIEGRYADAIFTNRYRKVLGQLSARKLLQDIMSRLAGGGGSGGGGSGGG<br>GSALVLQCIKVKNNRLPYVADKDSISQEIFENKIITDETNVQNYSDKFSLDESILDGQVPINPEIVDPLLP<br>NVNMEPLNLPGEEIVFYDDITKYVDYLNSYYYLESQKLSNNVENITLTTSVEEALGYSNKIYTFLPSLAEK<br>VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYF |
| SEQ ID 98 Protein sequence LHD CP Human GHRH 1-29 Ala substituted at position 8, Arg substituted at position 9 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE<br>NGSWKVTNIITPSVLIFGPLPNILDYTASLTLQGQQSNPSFEGFGTLSILKVAPEFLLTFSDVTSNQSSAV<br>LGKSIFCMDPVIALMHELTHSLHQLYGINIPSDKRIRPQVSEGFFSQDGPNVQFEELYTFGGLDVEIIPQI<br>ERSQLREKALGHYKDIAKRLNNINKTIPSSWISNIDKYKKIFSEKYNFDKDNTGNFVVNIDKFNSLYSDLT<br>NVMSEVVYSSQYNVKNRTHYFSRHYLPVFANILDDNIYTIRDGFNLTNKGFNIENSGQNIERNPALQKLSS<br>ESVVDLFTKVCVDGIITSKTKSLIEGRYADAIFTARYRKVLGQLSARKLLQDIMSRLAGGGGSGGGGSGGG<br>GSALVLQCIKVKNNRLPYVADKDSISQEIFENKIITDETNVQNYSDKFSLDESILDGQVPINPEIVDPLLP<br>NVNMEPLNLPGEEIVFYDDITKYVDYLNSYYYLESQKLSNNVENITLTTSVEEALGYSNKIYTFLPSLAEK<br>VNKGVQAGLFLNWANEVVEDFTTNIMKKDTLDKISDVSVIIPYIGPALNIGNSALRGNFNQAFATAGVAFL<br>LEGFPEFTIPALGVFTFYSSIQEREKIIKTIENCLEQRVKRWKDSYQWMVSNWLSRITTQFNHINYQMYDS<br>LSYQADAIKAKIDLEYKKYSGSDKENIKSQVENLKNSLDVKISEAMNNINKFIRECSVTYLFKNMLPKVID<br>ELNKFDLRTKTELINLIDSHNIILVGEVDRLKAKVNESFENTMPFNIFSYTNNSLLKDIINEYF |
| SEQ ID 99 Protein sequence LHD CP Human GHRH 1-40 Arg substituted at position 9 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE<br>NGSWKVTNIITPSVLIFGPLPNILDYTASLTLQGQQSNPSFEGFGTLSILKVAPEFLLTFSDVTSNQSSAV<br>LGKSIFCMDPVIALMHELTHSLHQLYGINIPSDKRIRPQVSEGFFSQDGPNVQFEELYTFGGLDVEIIPQI<br>ERSQLREKALGHYKDIAKRLNNINKTIPSSWISNIDKYKKIFSEKYNFDKDNTGNFVVNIDKFNSLYSDLT<br>NVMSEVVYSSQYNVKNRTHYFSRHYLPVFANILDDNIYTIRDGFNLTNKGFNIENSGQNIERNPALQKLSS<br>ESVVDLFTKVCVDGIITSKTKSLIEGRYADAIFTNRYRKVLGQLSARKLLQDIMSRQQGESNQERGALAGG<br>GGSGGGGSGGGGSALVLQCIKVKNNRLPYVADKDSISQEIFENKIITDETNVQNYSDKFSLDESILDGQVP<br>INPEIVDPLLPNVNMEPLNLPGEEIVFYDDITKYVDYLNSYYYLESQKLSNNVENITLTTSVEEALGYSNK<br>IYTFLPSLAEKVNKGVQAGLFLNWANEVVEDFTTNIMKKDTLDKISDVSVIIPYIGPALNIGNSALRGNFN<br>QAFATAGVAFLLEGFPEFTIPALGVFTFYSSIQEREKIIKTIENCLEQRVKRWKDSYQWMVSNWLSRITTQ<br>FNHINYQMYDSLSYQADAIKAKIDLEYKKYSGSDKENIKSQVENLKNSLDVKISEAMNNINKFIRECSVTY<br>LFKNMLPKVIDELNKFDLRTKTELINLIDSHNIILVGEVDRLKAKVNESFENTMPFNIFSYTNNSLLKDII<br>NEYF |
| SEQ ID 100 Protein sequence LHD CP Human GHRH1-44 Arg substituted at position 9 fusion<br>MTWPVKDFNYSDPVNDNDILYLRIPQNKLITTPVKAFMITQNIWVIPERFSSDTNPSLSKPPRPTSKYQSY<br>YDPSYLSTDEQKDTFLKGIIKLFKRINERDIGKKLINYLVVGSPFMGDSSTPEDTFDFTRHTTNIAVEKFE |

-continued

| SEQ IDs |
|---|

NGSWKVTNIITPSVLIFGPLPNILDYTASLTLQGQQSNPSFEGFGTLSILKVAPEFLLTFSDVTSNQSSAV

LGKSIFCMDPVIALMHELTHSLHQLYGINIPSDKRIRPQVSEGFFSQDGPNVQFEELYTFGGLDVEIIPQI

ERSQLREKALGHYKDIAKRLNNINKTIPSSWISNIDKYKKIFSEKYNFDKDNTGNFVVNIDKFNSLYSDLT

NVMSEVVYSSQYNVKNRTHYFSRHYLPVFANILDDNIYTIRDGFNLTNKGFNIENSGQNIERNPALQKLSS

ESVVDLFTKVCVDGIITSKTKSLIEGRYADAIFTNRYRKVLGQLSARKLLQDIMSRQQGESNQERGARARL

LAGGGGSGGGGSGGGGSALVLQCIKVKNNRLPYVADKDSISQEIFENKIITDETNVQNYSDKFSLDESILD

GQVPINPEIVDPLLPNVNMEPLNLPGEEIVFYDDITKYVDYLNSYYYLESQKLSNNVENITLTTSVEEALG

YSNKIYTFLPSLAEKVNKGVQAGLFLNWANEVVEDFTTNIMKKDTLDKISDVSVIIPYIGPALNIGNSALR

GNFNQAFATAGVAFLLEGFPEFTIPALGVFTFYSSIQEREKIIKTIENCLEQRVKRWKDSYQWMVSNWLSR

ITTQFNHINYQMYDSLSYQADAIKAKIDLEYKKYSGSDKENIKSQVENLKNSLDVKISEAMNNINKFIREC

SVTYLFKNMLPKVIDELNKFDLRTKTELINLIDSHNIILVGEVDRLKAKVNESFENTMPFNIFSYTNNSLL

KDIINEYF

SEQ ID 101 Protein sequence LHD CP Human GHRH1-29 Arg substituted at position 14, 15, 16 and 17 fusion
MTWPVKDFNYSDPVNDNDILYLRIPQNKLITTPVKAFMITQNIWVIPERFSSDTNPSLSKPPRPTSKYQSY

YDPSYLSTDEQKDTFLKGIIKLFKRINERDIGKKLINYLVVGSPFMGDSSTPEDTFDFTRHTTNIAVEKFE

NGSWKVTNIITPSVLIFGPLPNILDYTASLTLQGQQSNPSFEGFGTLSILKVAPEFLLTFSDVTSNQSSAV

LGKSIFCMDPVIALMHELTHSLHQLYGINIPSDKRIRPQVSEGFFSQDGPNVQFEELYTFGGLDVEIIPQI

ERSQLREKALGHYKDIAKRLNNINKTIPSSWISNIDKYKKIFSEKYNFDKDNTGNFVVNIDKFNSLYSDLT

NVMSEVVYSSQYNVKNRTHYFSRHYLPVFANILDDNIYTIRDGFNLTNKGFNIENSGQNIERNPALQKLSS

ESVVDLFTKVCVDGIITSKTKSLIEGRYADAIFTNSYRKVRRRRSARKLLQDIMSRLAGGGGSGGGGSGGG

GSALVLQCIKVKNNRLPYVADKDSISQEIFENKIITDETNVQNYSDKFSLDESILDGQVPINPEIVDPLLP

NVNMEPLNLPGEEIVFYDDITKYVDYLNSYYYLESQKLSNNVENITLTTSVEEALGYSNKIYTFLPSLAEK

VNKGVQAGLFLNWANEVVEDFTTNIMKKDTLDKISDVSVIIPYIGPALNIGNSALRGNFNQAFATAGVAFL

LEGFPEFTIPALGVFTFYSSIQEREKIIKTIENCLEQRVKRWKDSYQWMVSNWLSRITTQFNHINYQMYDS

LSYQADAIKAKIDLEYKKYSGSDKENIKSQVENLKNSLDVKISEAMNNINKFIRECSVTYLFKNMLPKVID

ELNKFDLRTKTELINLIDSHNIILVGEVDRLKAKVNESFENTMPFNIFSYTNNSLLKDIINEYF

SEQ ID 102 Protein sequence LHD CP Human GHRH1-40 Ala substituted at position 8 fusion
MTWPVKDFNYSDPVNDNDILYLRIPQNKLITTPVKAFMITQNIWVIPERFSSDTNPSLSKPPRPTSKYQSY

YDPSYLSTDEQKDTFLKGIIKLFKRINERDIGKKLINYLVVGSPFMGDSSTPEDTFDFTRHTTNIAVEKFE

NGSWKVTNIITPSVLIFGPLPNILDYTASLTLQGQQSNPSFEGFGTLSILKVAPEFLLTFSDVTSNQSSAV

LGKSIFCMDPVIALMHELTHSLHQLYGINIPSDKRIRPQVSEGFFSQDGPNVQFEELYTFGGLDVEIIPQI

ERSQLREKALGHYKDIAKRLNNINKTIPSSWISNIDKYKKIFSEKYNFDKDNTGNFVVNIDKFNSLYSDLT

NVMSEVVYSSQYNVKNRTHYFSRHYLPVFANILDDNIYTIRDGFNLTNKGFNIENSGQNIERNPALQKLSS

ESVVDLFTKVCVDGIITSKTKSLIEGRYADAIFTASYRKVLGQLSARKLLQDIMSRQQGESNQERGALAGG

GGSGGGGSGGGGSALVLQCIKVKNNRLPYVADKDSISQEIFENKIITDETNVQNYSDKFSLDESILDGQVP

INPEIVDPLLPNVNMEPLNLPGEEIVFYDDITKYVDYLNSYYYLESQKLSNNVENITLTTSVEEALGYSNK

IYTFLPSLAEKVNKGVQAGLFLNWANEVVEDFTTNIMKKDTLDKISDVSVIIPYIGPALNIGNSALRGNFN

QAFATAGVAFLLEGFPEFTIPALGVFTFYSSIQEREKIIKTIENCLEQRVKRWKDSYQWMVSNWLSRITTQ

-continued

| SEQ IDs |
|---|
| FNHINYQMYDSLSYQADAIKAKIDLEYKKYSGSDKENIKSQVENLKNSLDVKISEAMNNINKFIRECSVTY |
| LFKNMLPKVIDELNKFDLRTKTELINLIDSHNIILVGEVDRLKAKVNESFENTMPFNIFSYTNNSLLKDII |
| NEYF |
| SEQ ID 103 Protein sequence LHC CP Human GHRH 1-40 fusion PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTNSYRKVLGQLSARKLLQDIMSRQQGESNQERGALAGGG |
| GSGGGGSGGGGSALVLQCRELLVKNTDLPFIGDISDVKTDIFLRKDINEETEVIYYPDNVSVDQVILSKNT |
| SEHGQLDLLYPSIDSESEILPGENQVFYDNRTQNVDYLNSYYYLESQKLSDNVEDFTFTRSIEEALDNSAK |
| VYTYFFTLANKVNAGVQGGLFLMWANDVVEDFTTNILRKDTLDKISDVSAIIPYIGPALNISNSVRRGNFT |
| EAFAVTGVTILLEAFFEFTIPALGAFVIYSKVQERNEIIKTIDNCLEQRIKRWKDSYEWMMGTWLSRIITQ |
| FNNISYQMYDSLNYQAGAIKAKIDLEYKKYSGSDKENIKSQVENLKNSLDVKISEAMNNINKFIRECSVTY |
| LFKNMLPKVIDELNEFDRNTKAKLINLIDSHNIILVGEVDKLKAKVNNSFQNTIPFNIFSYTNNSLLKDII |
| NEYFN |
| SEQ ID 104 Protein sequence LHC CP Human GHRH 1-44 fusion PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTNSYRKVLGQLSARKLLQDIMSRQQGESNQERGARARLL |
| AGGGGSGGGGSGGGGSALVLQCRELLVKNTDLPFIGDISDVKTDIFLRKDINEETEVIYYPDNVSVDQVIL |
| SKNTSEHGQLDLLYPSIDSESEILPGENQVFYDNRTQNVDYLNSYYYLESQKLSDNVEDFTFTRSIEEALD |
| NSAKVYTYFPTLANKVNAGVQGGLFLMWANDVVEDFTTNILRKDTLDKISDVSAIIPYIGPALNISNSVRR |
| GNFTEAFAVTGVTILLEAFPEFTIPALGAFVIYSKVQERNEIIKTIDNCLEQRIKRWKDSYEWMMGTWLSR |
| IITQFNNISYQMYDSLNYQAGAIKAKIDLEYKKYSGSDKENIKSQVENLKNSLDVKISEAMNNINKFIREC |
| SVTYLFKNMLPKVIDELNEFDRNTKAKLINLIDSHNIILVGEVDKLKAKVNNSFQNTIPFNIFSYTNNSLL |
| KDIINEYFN |
| SEQ ID 105 Protein sequence LHC CP Human GHRH 1-29 Arg substituted at position 9 fusion PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |

-continued

| SEQ IDs |
|---|
| NMLYLFTKFCVDGIITSKTKSLIEGRYADAIFTNRYRKVLGQLSARKLLQDIMSRLAGGGGSGGGGSGGGG |
| SALVLQCRELLVKNTDLPFIGDISDVKTDIFLRKDINEETEVIYYPDNVSVDQVILSKNTSEHGQLDLLYP |
| SIDSESEILPGENQVFYDNRTQNVDYLNSYYYLESQKLSDNVEDFTFTRSIEEALDNSAKVYTYFPTLANK |
| VNAGVQGGLFLMWANDVVEDFTTNILRKDTLDKISDVSAIIPYIGPALNISNSVRRGNFTEAFAVTGVTIL |
| LEAFPEFTIPALGAFVIYSKVQERNEIIKTIDNCLEQRIKRWKDSYEWMMGTWLSRIITQFNNISYQMYDS |
| LNYQAGAIKAKIDLEYKKYSGSDKENIKSQVENLKNSLDVKISEAMNNINKFIRECSVTYLFKNMLPKVID |
| ELNEFDRNTKAKLINLIDSHNIILVGEVDKLKAKVNNSFQNTIPFNIFSYTNNSLLKDIINEYFN |
| SEQ ID 106 Protein sequence LHC CP Human GHRH1-29 Ala substituted at position 8, Arg substituted at position 9 fusion<br>PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTARYRKVLGQLSARKLLQDIMSRLAGGGGSGGGGSGGGG |
| SALVLQCRELLVKNTDLPFIGDISDVKTDIFLRKDINEETEVIYYPDNVSVDQVILSKNTSEHGQLDLLYP |
| SIDSESEILPGENQVFYDNRTQNVDYLNSYYYLESQKLSDNVEDFTFTRSIEEALDNSAKVYTYFPTLANK |
| VNAGVQGGLFLMWANDVVEDFTTNILRKDTLDKISDVSAIIPYIGPALNISNSVRRGNFTEAFAVTGVTIL |
| LEAFPEFTIPALGAFVIYSKVQERNEIIKTIDNCLEQRIKRWKDSYEWMMGTWLSRIITQFNNISYQMYDS |
| LNYQAGAIKAKIDLEYKKYSGSDKENIKSQVENLKNSLDVKISEAMNNINKFIRECSVTYLFKNMLPKVID |
| ELNEFDRNTKAKLINLIDSHNIILVGEVDKLKAKVNNSFQNTIPFNIFSYTNNSLLKDIINEYFN |
| SEQ ID 107 Protein sequence LHC CP Human GHRH1-40 Arg substituted at position 9 fusion<br>PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTNRYRKVLGQLSARKLLQDIMSRQQGESNQERGALAGGG |
| GSGGGGSGGGGSALVLQCRELLVKNTDLPFIGDISDVKTDIFLRKDINEETEVIYYPDNVSVDQVILSKNT |
| SEHGQLDLLYPSIDSESEILPGENQVFYDNRTQNVDYLNSYYYLESQKLSDNVEDFTFTRSIEEALDNSAK |
| VYTYFPTLANKVNAGVQGGLFLMWANDVVEDFTTNILRKDTLDKISDVSAIIPYIGPALNISNSVRRGNFT |
| EAFAVTGVTILLEAFPEFTIPALGAFVIYSKVQERNEIIKTIDNCLEQRIKRWKDSYEWMMGTWLSRIITQ |
| FNNISYQMYDSLNYQAGAIKAKIDLEYKKYSGSDKENIKSQVENLKNSLDVKISEAMNNINKFIRECSVTY |
| LFKNMLPKVIDELNEFDRNTKAKLINLIDSHNIILVGEVDKLKAKVNNSFQNTIPFNIFSYTNNSLLKDII |
| NEYFN |
| SEQ ID 108 Protein sequence LHC CP Human GHRH1-44 Arg substituted at position 9 fusion<br>PITINNFNYSDPVDNKNILYLDTHLNTLANEPEKAFRITGNIWVIPDRFSRNSNPNLNKPPRVTSPKSGYY |

-continued

| SEQ IDs |
|---|
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTNRYRKVLGQLSARKLLQDIMSRQQGESNQERGARARLL |
| AGGGGSGGGGSGGGGSALVLQCRELLVKNTDLPFIGDISDVKTDIFLRKDINEETEVIYYPDNVSVDQVIL |
| SKNTSEHGQLDLLYPSIDSESEILPGENQVFYDNRTQNVDYLNSYYYLESQKLSDNVEDFTFTRSIEEALD |
| NSAKVYTYFPTLANKVNAGVQGGLFLMWANDVVEDFTTNILRKDTLDKISDVSAIIPYIGPALNISNSVRR |
| GNFTEAFAVTGVTILLEAFPEFTIPALGAFVIYSKVQERNEIIKTIDNCLEQRIKRWKDSYEWMMGTWLSR |
| IITQFNNISYQMYDSLNYQAGAIKAKIDLEYKKYSGSDKENIKSQVENLKNSLDVKISEAMNNINKFIREC |
| SVTYLFKNMLPKVIDELNEFDRNTKAKLINLIDSHNIILVGEVDKLKAKVNNSFQNTIPFNIFSYTNNSLL |
| KDIINEYFN |
| SEQ ID 109 Protein sequence LHC CP Human GHRH1-29 Arg substituted at position 14, 15, 16 and 17 fusion |
| PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTNSYRKVRRRRSARKLLQDIMSRLAGGGGSGGGGSGGGG |
| SALVLQCRELLVKNTDLPFIGDISDVKTDIFLRKDINEETEVIYYPDNVSVDQVILSKNTSEHGQLDLLYP |
| SIDSESEILPGENQVFYDNRTQNVDYLNSYYYLESQKLSDNVEDFTFTRSIEEALDNSAKVYTYFPTLANK |
| VNAGVQGGLFLMWANDVVEDFTTNILRKDTLDKISDVSAIIPYIGPALNISNSVRRGNFTEAFAVTGVTIL |
| LEAFPEFTIPALGAFVIYSKVQERNEIIKTIDNCLEQRIKRWKDSYEWMMGTWLSRIITQFNNISYQMYDS |
| LNYQAGAIKAKIDLEYKKYSGSDKENIKSQVENLKNSLDVKISEAMNNINKFIRECSVTYLFKNMLPKVID |
| ELNEFDRNTKAKLINLIDSHNIILVGEVDKLKAKVNNSFQNTIPFNIFSYTNNSLLKDIINEYFN |
| SEQ ID 110 Protein sequence LHC CP Human GHRH1-40 Ala substituted at position 8 fusion |
| PITINNFNYSDPVDNKNILYLDTHLNTLANEPEKAFRITGNIWVIPDRFSRNSNPNLNKPPRVTSPKSGYY |
| DPNYLSTDSDKDTFLKEIIKLFKRINSREIGEELIYRLSTDIPFPGNNNTPINTFDFDVDFNSVDVKTRQG |
| NNWVKTGSINPSVIITGPRENIIDPETSTFKLTNNTFAAQEGFGALSIISISPRFMLTYSNATNDVGEGRF |
| SKSEFCMDPILILMHELNHAMHNLYGIAIPNDQTISSVTSNIFYSQYNVKLEYAEIYAFGGPTIDLIPKSA |
| RKYFEEKALDYYRSIAKRLNSITTANPSSFNKYIGEYKQKLIRKYRFVVESSGEVTVNRNKFVELYNELTQ |
| IFTEFNYAKIYNVQNRKIYLSNVYTPVTANILDDNVYDIQNGFNIPKSNLNVLFMGQNLSRNPALRKVNPE |
| NMLYLFTKFCVDGIITSKTKSLIEGRYADAIFTASYRKVLGQLSARKLLQDIMSRQQGESNQERGALAGGG |
| GSGGGGSGGGGSALVLQCRELLVKNTDLPFIGDISDVKTDIFLRKDINEETEVIYYPDNVSVDQVILSKNT |
| SEHGQLDLLYPSIDSESEILPGENQVFYDNRTQNVDYLNSYYYLESQKLSDNVEDFTFTRSIEEALDNSAK |
| VYTYFPTLANKVNAGVQGGLFLMWANDVVEDFTTNILRKDTLDKISDVSAIIPYIGPALNISNSVRRGNFT |
| EAFAVTGVTILLEAFPEFTIPALGAFVIYSKVQERNEIIKTIDNCLEQRIKRWKDSYEWMMGTWLSRIITQ |

-continued

| SEQ IDs |
| --- |

FNNISYQMYDSLNYQAGAIKAKIDLEYKKYSGSDKENIKSQVENLKNSLDVKISEAMNNINKFIRECSVTY

LFKNMLPKVIDELNEFDRNTKAKLINLIDSHNIILVGEVDKLKAKVNNSFQNTIPFNIFSYTNNSLLKDII

NEYFN

SEQ ID 111 Protein sequence of LHD CP qGHRH fusion
MTWPVKDFNYSDPVNDNDILYLRIPQNKLITTPVKAFMITQNIWVIPERFSSDTNPSLSKPPRPTSKYQSY

YDPSYLSTDEQKDTFLKGIIKLFKRINERDIGKKLINYLVVGSPFMGDSSTPEDTFDFTRHTTNIAVEKFE

NGSWKVTNIITPSVLIFGPLPNILDYTASLTLQGQQSNPSFEGFGTLSILKVAPEFLLTFSDVTSNQSSAV

LGKSIFCMDPVIALMHELTHSLHQLYGINIPSDKRIRPQVSEGFFSQDGPNVQFEELYTFGGLDVEIIPQI

ERSQLREKALGHYKDIAKRLNNINKTIPSSWISNIDKYKKIFSEKYNFDKDNTGNFVVNIDKFNSLYSDLT

NVMSEVVYSSQYNVKNRTHYFSRHYLPVFANILDDNIYTIRDGFNLTNKGFNIENSGQNIERNPALQKLSS

ESVVDLFTKVCVDGIITSKTKSLIEGRHVDAIFTQSYRKVLAQLSARKLLQDILNRQQGERNQEQGALAGG

GGSGGGGSGGGGSALVLQCIKVKNNRLPYVADKDSISQEIFENKIITDETNVQNYSDKFSLDESILDGQVP

INPEIVDPLLPNVNMEPLNLPGEEIVFYDDITKYVDYLNSYYYLESQKLSNNVENITLTTSVEEALGYSNK

IYTFLPSLAEKVNKGVQAGLFLNWANEVVEDFTTNIMKKDTLDKISDVSVIIPYIGPALNIGNSALRGNFN

QAFATAGVAFLLEGFPEFTIPALGVFTFYSSIQEREKIIKTIENCLEQRVKRWKDSYQWMVSNWLSRITTQ

FNHINYQMYDSLSYQADAIKAKIDLEYKKYSGSDKENIKSQVENLKNSLDVKISEAMNNINKFIRECSVTY

LFKNMLPKVIDELNKFDLRTKTELINLIDSHNIILVGEVDRLKAKVNESFENTMPFNIFSYTNNSLLKDII

NEYF

SEQ ID 112 DNA sequence of the LHD CP qGHRH fusion
ATGACCTGGCCGGTCAAAGACTTCAACTATAGCGATCCGGTCAACGACAACGATATCCTGTATCTGCGCAT

TCCGCAGAACAAACTGATTACCACGCCGGTGAAAGCCTTCATGATTACTCAGAACATCTGGGTGATCCCGG

AACGTTTTTCTTCCGATACTAACCCGTCTCTGTCTAAACCGCCGCGTCCGACCTCCAAATATCAGTCTTAC

TACGATCCGTCTTACCTGTCCACCGACGAACAGAAAGACACGTTTCTGAAAGGCATCATCAAACTGTTCAA

ACGTATCAACGAGCGTGACATTGGCAAAAAACTGATCAACTACCTGGTAGTGGGTTCTCCGTTCATGGGTG

ATTCTAGCACTCCGGAAGATACCTTCGACTTCACTCGCCACACCACTAACATCGCAGTGGAAAAATTCGAG

AACGGTAGCTGGAAAGTCACCAACATCATCACTCCGTCTGTTCTGATCTTTGGTCCGCTGCCGAACATTCT

GGACTATACTGCATCTCTGACCCTGCAGGGTCAGCAGAGCAACCCGTCCTTCGAAGGCTTCGGTACCCTGT

CTATCCTGAAAGTTGCACCGGAATTCCTGCTGACTTTCAGCGACGTTACCTCTAACCAGTCCTCTGCAGTA

CTGGGTAAAAGCATTTTCTGCATGGACCCGGTTATTGCTCTGATGCATGAACTGACCCACAGCCTGCACCA

GCTGTATGGTATCAACATCCCGTCTGATAAACGCATTCGTCCGCAGGTCTCTGAAGGTTTCTTTTCTCAGG

ATGGCCCGAACGTTCAGTTCGAGGAACTGTATACTTTCGGTGGCCTGGATGTTGAAATCATTCCGCAGATC

GAACGTTCTCAGCTGCGCGAAAAAGCGCTGGGTCACTACAAAGATATCGCAAAACGCCTGAACAACATCAA

CAAAACGATTCCGTCCAGCTGGATCTCCAACATCGATAAATACAAAAAAATCTTCTCCGAGAAATACAACT

TCGATAAAGACAACACTGGCAACTTCGTGGTCAACATCGACAAATTCAACTCTCTGTACAGCGACCTGACC

AACGTTATGTCCGAAGTCGTTTACTCTTCCCAGTACAACGTCAAAAACCGTACCCACTATTTTTCTCGCCA

CTATCTGCCGGTATTCGCGAACATTCTGGACGACAACATTTACACGATCCGCGATGGCTTCAACCTGACCA

ACAAAGGCTTTAACATCGAGAACAGCGGTCAGAACATTGAACGTAACCCGGCACTGCAGAAACTGTCCTCT

GAATCTGTGGTTGATCTGTTTACCAAAGTATGCGTAGACGGCATTATCACCTCCAAAACCAAATCCCTGAT

TGAAGGTCGCCACGTGGATGCGATCTTCACTCAGTCTTACCGTAAAGTTCTGGCGCAGCTGAGCGCTCGTA

-continued

| SEQ IDs |
| --- |
| AACTGCTGCAGGATATCCTGAACCGTCAGCAGGGTGAACGTAACCAGGAACAGGGCGCTCTGGCTGGTGGC |
| GGTGGCTCTGGTGGCGGCGGTTCTGGCGGCGGTGGTTCTGCCCTGGTACTGCAGTGTATCAAAGTGAAAAA |
| CAACCGTCTGCCGTACGTTGCCGATAAAGATTCTATCTCTCAGGAGATCTTCGAGAACAAAATTATCACCG |
| ACGAGACCAACGTTCAGAACTACAGCGACAAATTTAGCCTGGATGAATCCATCCTGGATGGTCAGGTGCCG |
| ATCAACCCGGAAATCGTAGATCCGCTGCTGCCGAACGTTAACATGGAACCGCTGAACCTGCCGGGTGAGGA |
| AATCGTCTTTTACGATGACATCACCAAATACGTGGACTATCTGAACTCCTATTACTACCTGGAATCCCAGA |
| AACTGTCCAACAACGTCGAAAACATTACTCTGACTACGTCTGTTGAGGAAGCCCTGGGCTACTCTAACAAA |
| ATCTACACGTTTCTGCCGTCCCTGGCGGAAAAAGTAAACAAAGGTGTTCAGGCAGGCCTGTTTCTGAACTG |
| GGCTAACGAGGTTGTGGAAGATTTCACCACCAACATTATGAAAAAAGACACCCTGGACAAAATCTCTGACG |
| TATCTGTGATCATTCCGTACATCGGTCCGGCTCTGAACATTGGTAACTCTGCTCTGCGTGGCAACTTCAAC |
| CAGGCGTTTGCTACTGCAGGCGTAGCTTTCCTGCTGGAAGGTTTTCCGGAGTTTACCATTCCGGCCCTGGG |
| TGTTTTCACCTTCTATAGCTCCATTCAGGAGCGTGAGAAAATCATTAAAACCATCGAGAACTGTCTGGAAC |
| AGCGCGTGAAACGTTGGAAAGATTCTTATCAGTGGATGGTTTCTAACTGGCTGTCTCGTATCACCACGCAG |
| TTCAACCATATTAACTACCAGATGTACGATAGCCTGTCTTACCAGGCGGACGCTATCAAAGCGAAAATCGA |
| CCTGGAGTATAAAAAATACTCTGGCAGCGACAAAGAAAACATCAAAAGCCAGGTGGAAAACCTGAAAAACT |
| CCCTGGACGTGAAAATCTCCGAAGCGATGAACAACATCAACAAATTTATCCGTGAGTGCAGCGTCACGTAC |
| CTGTTCAAAAACATGCTGCCGAAAGTGATCGACGAGCTGAACAAATTTGACCTGCGCACCAAAACCGAGCT |
| GATCAACCTGATTGATTCCCATAACATCATCCTGGTAGGTGAAGTTGACCGTCTGAAAGCGAAAGTTAACG |
| AATCTTTCGAAAACACTATGCCGTTCAACATTTTTAGCTATACCAACAACTCTCTGCTGAAAGACATTATC |
| AACGAATACTTC |

Example 1

Preparation of a $LH_N/A$ Backbone Construct

The following procedure creates a clone for use as an expression backbone for multidomain protein expression. This example is based on preparation of a serotype A based clone (SEQ ID1), though the procedures and methods are equally applicable to all $LH_N$ serotypes such as serotype B (SEQ ID2), serotype C (SEQ ID3) and serotype D (SEQ ID4) and other protease or translocation domains such as IgA and Tetanus $H_N$ by using the appropriate published sequence for synthesis (SEQ ID32).

Preparation of Cloning and Expression Vectors pCR 4 (Invitrogen) is the chosen standard cloning vector chosen due to the lack of restriction sequences within the vector and adjacent sequencing primer sites for easy construct confirmation. The expression vector is based on the pET (Novagen) expression vector which has been modified to contain the multiple cloning site NdeI-BamHI-SalI-PstI-XbaI-HindIII for construct insertion, a fragment of the expression vector has been removed to create a non-mobilisable plasmid, a variety of different fusion tags have been inserted to increase purification options and an existing XbaI site in the vector backbone has been removed to simplify sub-cloning.

Preparation of LC/A

The DNA sequence is designed by back translation of the LC/A amino acid sequence (obtained from freely available database sources such as GenBank (accession number P10845) using one of a variety of reverse translation software tools (for example Backtranslation tool v2.0 (Entelechon)). BamHI/SalI recognition sequences are incorporated at the 5' and 3' ends respectively of the sequence maintaining the correct reading frame. The DNA sequence is screened (using software such as SeqBuilder, DNASTAR Inc.) for restriction enzyme cleavage sequences incorporated during the back translation. Any cleavage sequences that are found to be common to those required by the cloning system are removed by the Backtranslation tool from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence containing the LC/A open reading frame (ORF) is then commercially synthesized (for example by Entelechon, Geneart or Sigma-Genosys) and is provided in the pCR 4 vector.

Preparation of $H_N/A$ Insert

The DNA sequence is designed by back translation of the $H_N/A$ amino acid sequence (obtained from freely available database sources such as GenBank (accession number P10845) using one of a variety of reverse translation software tools (for example Back translation tool v2.0 (Entelechon)). A PstI restriction sequence added to the N-terminus and XbaI-stop codon-HindIII to the C-terminus ensuring the correct reading frame in maintained. The DNA sequence is screened (using software such as SeqBuilder, DNASTAR Inc.) for restriction enzyme cleavage sequences incorporated during the back translation. Any sequences that are found to be common to those required by the cloning system are removed by the Backtranslation tool from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Preparation of the Interdomain (LC-$H_N$ Linker)

The LC-$H_N$ linker can be designed from first principle, using the existing sequence information for the linker as the template. For example, the serotype A linker (in this case defined as the inter-domain polypeptide region that exists between the cysteines of the disulphide bridge between LC and $H_N$) has the sequence VRGIIPFKTKSLDEGYNKALNDL. This sequence information is freely available from available database sources such as GenBank (accession number P10845). For generation of a specific protease cleavage site, the native recognition sequence for Factor Xa can be used in the modified sequence VDGIITSKTKSLIEGR or an enterokinase recognition sequence is inserted into the activation loop to generate the sequence VDGIITSKTKSDDDDKNKALNLQ. Using one of a variety of reverse translation software tools (for example Backtranslation tool v2.0 (Entelechon), the DNA sequence encoding the linker region is determined. BamHI/SalI and PstI/XbaI/stop codon/HindIII restriction enzyme sequences are incorporated at either end, in the correct reading frames. The DNA sequence is screened (using software such as Seqbuilder, DNASTAR Inc.) for restriction enzyme cleavage sequences incorporated during the back translation. Any sequences that are found to be common to those required by the cloning system are removed by the Backtranslation tool from the proposed coding sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Assembly and Confirmation of the Backbone Clone

Due to the small size, the activation linker must be transferred using a two step process. The pCR-4 linker vector is cleaved with BamHI+PstI SalI combination restriction enzymes and the cleaved linker vector then serves as the recipient for BamHHI+SalI restriction enzyme cleaved LC DNA. Once the LC encoding DNA is inserted upstream of the linker DNA, the entire LC-linker DNA fragment can then be isolated and transferred to the pET expression vector MCS. The LC-linker is cut out from the pCR 4 cloning vector using BamHI/PstI restriction enzymes digests. The pET expression vector is digested with the same enzymes but is also treated with antarctic phosphatase as an extra precaution to prevent re-circularisation. The LC-linker and the pET vector backbone are gel purified and the purified insert and vector backbone are ligated together using T4 DNA ligase. The product is transformed with TOP10 cells which are then screened for LC-linker using BamHI/PstI restriction digestion. The process is then repeated for the $H_N$ insertion into the PstI/HindIII restriction sites of the pET-LC-linker construct.

Screening with restriction enzymes is sufficient to ensure the final backbone is correct as all components are already sequenced confirmed during synthesis. However, during the sub-cloning of some components into the backbone, where similar size fragments are being removed and inserted, sequencing of a small region to confirm correct insertion is required.

Example 2

Construction of LH$_N$/A-CP-GS15-SST28

The following procedure creates a clone for use as an expression construct for multidomain fusion expression where the targeting moiety (TM) is presented centrally between the protease and translocation domain. This example is based on preparation of the LH$_N$/A-CP-GS15-SST28 fusion (SEQ ID25), though the procedures and methods are equally applicable to create other protease, translocation and TM fusions (such as SEQ ID NOs: 95, 96, 97, 98, 99, 100, 101, 102, 103, 104, 105, 106, 107, 108, 109, 110 or 111), where the TM is N-terminal to the translocation domain. In this example, a flanking 15 amino acid glycine-serine spacer $(G_4S)3$ is engineered into the interdomain sequence ensure accessibility of the ligand to its receptor, but other spacers are applicable.

Preparation of Spacer-Human SST28 Insert

The LC-$H_N$ inter-domain polypeptide linker region exists between the cysteines of the disulphide bridge between LC and $H_N$. For insertion of a protease cleavage site, spacer and a targeting moiety (TM) region into the activation loop, one of a variety of reverse translation software tools (for example Backtranslation tool v2.0 (Entelechon) are used to determine the DNA sequence encoding the linker region. For central presentation of an SST28 sequence at the N-terminus of the $H_N$ domain, a DNA sequence is designed for the GS spacer and targeting moiety (TM) regions allowing incorporation into the backbone clone (SEQ ID1). The DNA sequence can be arranged as BamHI-SalI-spacer-protease activation site-SST28-spacer-PstI-XbaI-stop codon-HindIII (SEQ ID5). Once the TM DNA is designed, the additional DNA required to encode the preferred spacer is created in silico. It is important to ensure the correct reading frame is maintained for the spacer, SST28 and restriction sequences and that the XbaI sequence is not preceded by the bases TC, which would result in DAM methylation. The DNA sequence is screened for restriction sequence incorporated and any additional sites are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Assembly and Confirmation of the Backbone Clone

In order to create a LC-spacer-activation site-SST28-spacer-$H_N$ construct (SEQ ID25) using the backbone construct (SEQ ID1) and the newly synthesised pCR 4-spacer-activation site-TM-spacer vector encoding the SST28 TM (SEQ ID5), a one or two step method can be used; typically the two step method is used when the TM DNA is less than 100 base pairs. Using the one step method the SST28 linker region can be inserted directly into the backbone construct buy cutting the pCR 4-spacer-activation site-TM-spacer vector with SalI and PstI restriction enzymes and inserting the TM encoding DNA fragment into a similarly cut pET backbone construct. Using the two-step method the LC domain is excised from the backbone clone using restriction enzymes SamHI and SalI and ligated into similarly digested pCR 4-spacer-activation site-TM-spacer vector. This creates a LC-spacer-activation site-SST28-spacer ORF in pCR 4 that can be excised from the vector using restriction enzymes BamHI and PstI for subsequent ligation into similarly pET expression construct. The final construct contains the LC-spacer-activation site-SST28-spacer-$H_N$ DNA (SEQ ID25) which will result in a fusion protein containing the sequence illustrated in SEQ ID26. Similarly, by way of example, other CP fusions of the present invention (e.g. SEQ ID NO: 111) may be expressed from the corresponding nucleic acid sequences (e.g. SEQ ID NO: 112).

Example 3

Expression and Purification of a $LH_N$/A-CP-SST28 Fusion Protein

This example is based on preparation of an $LH_N$/A protein that incorporates a SST28 TM polypeptide into the interdomain linker region (SEQ ID26), where the pET expression vector ORF also encodes a histidine purification tag. These procedures and methods are equally applicable to the other fusion protein such as those shown in SEQ ID7-14, 42-48, 57, 60-91, 95, 96, 97, 98, 99, 100, 101, 102, 103, 104, 105, 106, 107, 108, 109, 110 or 111. Where appropriate, the activation enzyme should be selected to be compatible with the protease activation site within each sequence Expression of $LH_N$/A-CP-SST28

Expression of the $LH_N$/A-CP-SST28 protein is achieved using the following protocol. Inoculate 100 ml of modified TB containing 0.2% glucosamine and 30 μg/ml kanamycin in a 250 ml flask with a single colony from the LHA-CP-SST28expression strain. Grow the culture at 37° C., 225 rpm for 16 hours. Inoculate 1 L of modified TB containing 0.2% glucosamine and 30 μg/ml kanamycin in a 2 L flask with 10 ml of overnight culture. Grow cultures at 37° C. until an approximate $OD_{600}$ nm of 0.5 is reached at which point reduce the temperature to 16° C. After 1 hour induce the cultures with 1 mM IPTG and grow at 16° C. for a further 16 hours.

Purification of $LH_N$/A-CP-SST28 Protein

Defrost falcon tube containing 35 ml 50 mM HEPES pH 7.2 200 mM NaCl and approximately 10 g of *E. coli* BL21 (DE3) cell paste. Homogenise the cell paste (20 psi) ensuring the sample remains cool. Spin the lysed cells at 18 000 rpm, 4° C. for 30 minutes. Load the supernatant onto a 0.1 M NiSO4 charged Chelating column (20-30 ml column is sufficient) equilibrated with 50 mM HEPES pH 7.2 200 mM NaCl. Using a step gradient of 10, 40 and 100 mM imidazole, wash away the non-specific bound protein and elute the fusion protein with 200 mM imidazole. The eluted fusion protein is dialysed against 5 L of 50 mM HEPES pH 7.2 200 mM NaCl at 4° C. overnight and the $OD_{280}$ nm measured to establish the protein concentration. Add 3.2 μl enterokinase (New England Biolabs) per mg fusion protein and incubate static overnight at 25° C. Load onto a 0.1 M NiSO4 charged Chelating column (20-30 ml column is sufficient) equilibrated with 50 mM HEPES pH 7.2 200 mM NaCl. Wash column to baseline with 50 mM HEPES pH 7.2 200 mM NaCl. Using a step gradient of 10, 40 and 100 mM imidazole, wash away the non-specific bound protein and elute the fusion protein with 200 mM imidazole. Dialyse the eluted fusion protein against 5 L of 50 mM HEPES pH 7.2 150 mM NaCl at 4° C. overnight and concentrate the fusion to about 2 mg/ml, aliquot sample and freeze at −20° C. Test purified protein using $OD_{280}$, BCA and purity analysis.

Example 4

Construction of $LH_N$/D-CT-GS20-CST28

The following procedure creates a clone for use as an expression construct for multidomain fusion expression where the targeting moiety (TM) is presented C-terminally to the translocation domain. This example is based on preparation of the $LH_N$/D-CT-GS20-CST28 fusion (SEQ ID17), though the procedures and methods are equally applicable to create other protease, translocation and TM fusions, where the TM of C-terminal to the translocation domain. In this example, a flanking 20 amino acid glycine-serine spacer is engineered into the interdomain sequence ensure accessibility of the ligand to its receptor, but other spacers are applicable.

Preparation of Spacer-Human CST28 Insert

For presentation of a CST28 sequence at the C-terminus of the $H_N$ domain, a DNA sequence is designed to flank the spacer and targeting moiety (TM) regions allowing incorporation into the backbone clone (SEQ ID4). The DNA sequence can be arranged as SamHI-SalI-PstI-XbaI-spacer-CST28-stop codon-HindIII (SEQ ID6). The DNA sequence can be designed using one of a variety of reverse translation software tools (for example EditSeq best *E. coli* reverse translation (DNASTAR Inc.), or Backtranslation tool v2.0 (Entelechon)). Once the TM DNA is designed, the additional DNA required to encode the preferred spacer is created in silico. It is important to ensure the correct reading frame is maintained for the spacer, CST28 and restriction sequences and that the XbaI sequence is not preceded by the bases TC, which would result on DAM methylation. The DNA sequence is screened for restriction sequences incorporated and any additional sequences are removed manually from the remaining sequence ensuring common *E. coli* codon usage is maintained. *E. coli* codon usage is assessed by reference to software programs such as Graphical Codon Usage Analyser (Geneart), and the % GC content and codon usage ratio assessed by reference to published codon usage tables (for example GenBank Release 143, Sep. 13, 2004). This optimised DNA sequence is then commercially synthesized (for example by Entelechon, Geneart or Sigma-Genosys) and is provided in the pCR 4 vector.

Assembly and Confirmation of the Backbone Clone

In order to create a $LH_N$/D-GS20-CST28 construct (SEQ ID17) using the backbone construct (SEQ ID4) and the newly synthesised pCR 4-spacer-TM vector encoding the CST28 TM (SEQ ID6), a one or two step method can be used; typically the two step method is used when the TM DNA is less than 100 base pairs. Using the one step method the CST28 can be inserted directly into the backbone construct buy cutting the pCR 4-spacer-TM vector with XbaI and HindIII restriction enzymes and inserting the TM encoding DNA fragment into a similarly cut pET backbone construct. Using the two-step method the $LH_N$ domain is excised from the backbone clone using restriction enzymes BamHI and XbaI and ligated into similarly digested pCR 4-spacer-CST28 vector. This creates an $LH_N$-spacer-CST28 ORF in pCR 4 that can be excised from the vector using restriction enzymes BamHI and HindIII for subsequent ligation into the similarly cleaved pET expression construct. The final construct contains the LC-linker-$H_N$-spacer-CST28 DNA (SEQ ID17) which will result in a fusion protein containing the sequence illustrated in SEQ ID18.

Example 5

Expression and Purification of a $LH_N$/D-CT-CST28 Fusion Protein

This example is based on preparation of an $LH_N$/D protein that incorporates a CST28 TM polypeptide at the carboxyl terminus of the $H_N$ domain (SEQ ID 18), where the pET expression vector ORF also encodes a histidine purification tag. These procedures and methods are equally applicable to fusion protein sequences such as those shown in SEQ ID15, 16, 18-24, 27-31, 33-41, 58-59, and 93-94. Where appropriate, the activation enzyme should be selected to be compatible with the protease activation site within each sequence.

Expression of $LH_N$/D-CT-CST28

Expression of the $LH_N$/D-CT-CST28 protein is achieved using the following protocol. Inoculate 100 ml of modified TB containing 0.2% glucosamine and 30 μg/ml kanamycin in a 250 ml flask with a single colony from the $LH_N$/D-CT-CST28 expression strain. Grow the culture at 37° C., 225 rpm for 16 hours. Inoculate 1 L of modified TB containing 0.2% glucosamine and 30 μg/ml kanamycin in a 2 L flask with 10 ml of overnight culture. Grow cultures at 37° C. until an approximate $OD_{600}$ nm of 0.5 is reached at which point reduce the temperature to 16° C. After 1 hour induce the cultures with 1 mM IPTG and grow at 16° C. for a further 16 hours.

Purification of $LH_N$/D-CT-CST28 Protein

Defrost falcon tube containing 35 ml 50 mM HEPES pH 7.2 200 mM NaCl and approximately 10 g of *E. coli* BL21 (DE3) cell paste. Homogenise the cell paste (20 psi) ensuring the sample remains cool. Spin the lysed cells at 18 000 rpm, 4° C. for 30 minutes. Load the supernatant onto a 0.1 M NiSO4 charged Chelating column (20-30 ml column is sufficient) equilibrated with 50 mM HEPES pH 7.2 200 mM NaCl. Using a step gradient of 10, 40 and 100 mM imidazole, wash away the non-specific bound protein and elute the fusion protein with 200 mM imidazole. The eluted fusion protein is dialysed against 5 L of 50 mM HEPES pH 7.2 200 mM NaCl at 4° C. overnight and the $OD_{280}$ nm measured to establish the protein concentration. Add 3.2 μl enterokinase (New England Biolabs) per mg fusion protein and incubate static overnight at 25° C. Load onto a 0.1 M $NiSO_4$ charged Chelating column (20-30 ml column is sufficient) equilibrated with 50 mM HEPES pH 7.2 200 mM NaCl. Wash column to baseline with 50 mM HEPES pH 7.2 200 mM NaCl. Using a step gradient of 10, 40 and 100 mM imidazole, wash away the non-specific bound protein and elute the fusion protein with 200 mM imidazole. Dialyse the eluted fusion protein against 5 L of 50 mM HEPES pH 7.2 150 mM NaCl at 4° C. overnight and concentrate the fusion to about 2 mg/ml, aliquot sample and freeze at −20° C. Test purified protein using $OD_{280}$, BCA and purity analysis. FIGS. 1 and 2 demonstrate purification of fusion proteins as analysed by SDS-PAGE.

Example 6

Chemical Conjugation of $LH_N$/A to SST TM

The following procedure creates a chemically conjugated molecule containing the $LH_N$/A amino acid sequence (SEQ ID49), prepared from SEQ ID1 using the production method outlined in example 3, and a SST Octreotide peptide which has been chemically synthesised (SEQ ID54). However, the procedures and methods are equally applicable for the conjugation of other peptides such as SEQ ID55 and SEQ ID56 to other protease/translocation domain proteins such as those containing the amino acid sequences SEQ ID50, 51, 52 and 53.

The $LH_N$/A protein was buffer exchanged from 50 mM Hepes 150 mM salt into PBSE (100 mM 14.2 g NA2HPO4, 100 mM 5.85 g NaCl, 1 mM $EDTANa_2$ pH 7.5 with 1M HCl) using the Bio-rad PD10 column. This was done by washing one column volume of PBSE through the PD10 column, the protein was then added to the column until no more drops exit the end of the PD10 column. 8 mls of PBSE was then added and 0.5 ml fractions are collected. The collected fractions are the measured using the $A_{280}$ reading and fractions containing protein are pooled. A concentration of 1.55 mg/ml of $LH_N$/A was obtained from the buffer exchange step and this was used to set up the following reactions:

| $LH_N$/A 1.55 mg/ml | 20 mM SPDP or Sulfo-LC-SPDP |
|---|---|
| A 200 μl | 0 |
| B 200 μl | 4 fold increase 0.62 μl |
| C 200 μl | 8 fold increase 1.24 μl |

Sample were left to tumble at RT for 3 hours before being passed down another PD10 column to buffer exchange into PBSE and the protein containing fractions pooled. A final concentration of 25 mM DTT was then added to derivatised protein and then the samples left at room temperature for 10 minutes. $A_{280}$ and $A_{343}$ readings were then taken to work out the ratio of SPDP:$LH_N$/A interaction and the reaction which resulted in a derivatisation ration of between 1 and 3 was used for the peptide conjugation. The SPDP reagent binds to the primary amines of the $LH_N$/A via an N-hydroxysuccinimide (NHS) ester, leaving the sulphydryl-reactive portion to form a disulphide bond to the free SH group on the free cysteine on the synthesised peptide. In this case the peptide sequence is Octreotide which has been synthesised with a free cysteine on the N-terminus (SEQ ID91). The SPDP-derivatised $LH_N$/A was mixed with a 4-fold excess of the Octreotide ligand and the reaction was then left at RT for 90 minutes whilst tumbling. The excess octreotide was then removed using either a PD10 column leaving $LH_N$/A-Octreotide conjugated molecule.

Example 7

Activity of SST-$LH_N$/A in Cultured Endocrine Cells (AtT20)

The rat pituitary tumour cell line AtT20 is an example of a cell line of endocrine origin. It thus represents a model cell line for the investigation of inhibition-of-release effects of the agents.

AtT20 cells possess surface receptors that allow for the binding, and internalisation, of SST-$LH_N$/A. In contrast, AtT20 cells lack suitable receptors for clostridial neurotoxins and are therefore not susceptible to botulinum neurotoxins (BoNTs).

FIG. 3(*a*) illustrates the inhibition of release of ACTH from AtT20 cells after prior incubation with SST-$LH_N$/A. It is clear that dose-dependent inhibition is observed, indicating that SST-$L_H$/A can inhibit the release of ACTH from an endocrine cell model. Inhibition of ACTH release was demonstrated to correlate with cleavage of the SNARE protein SNAP25 (FIG. 3(*a*) and (*b*)) Thus, inhibition of release of chemical messenger is due to a clostridial endopeptidase-mediated effect of SNARE-protein cleavage.

Materials and Methods

ACTH enzyme immunoassay kits were obtained from Bachem Research Inc., CA, USA. Western blotting reagents were obtained from Invitrogen and Sigma. AtT20 cells were seeded onto 12 well plates and cultured in DMEM containing 10% foetal bovine serum, 4 mM Glutamax. After 1 day SST-$LH_N$/A was applied for 72 hours then the cells washed to remove unbound SST-$LH_N$/A. Secretion of ACTH was stimulated by elevating the concentration of extracellular potassium (60 mM KCl) and calcium (5 mM $CaCl_2$) for 30 min. The medium was harvested from the cells and stored at −20° C. until assayed for ACTH content using the immunoassay kit and following the manufacturer's instructions. Cells were solubilised in 1× LDS electrophoresis reducing sample buffer, heated for 10 minutes at 90° C. then stored at −20° C. until used for Western blotting. Stimulated secretion was calculated by subtracting basal release from total release under stimulating conditions. Solubilised cell samples were separated by SDS-PAGE and transferred to nitrocellulose membrane. Proteolysis of SNAP-25, a crucial component of the neurosecretory process and the substrate for the zinc-dependent endopeptidase activity of BoNT/A, was then detected by probing with an antibody that recognises both the intact and cleaved forms of SNAP-25. Quantitation of proteolysis was achieved by image analysis using a Synoptics Syngene GeneGnome imaging system and GeneTools software.

Example 8

Activity of SST-$LH_N$/D in Cultured Neuroendocrine Cells (GH3)

The rat pituitary cell line GH3 is an example of a cell line of neuroendocrine origin. It thus represents a model cell line for the investigation of inhibition-of-release effects of the agents.

GH3 cells possess surface receptors that allow for the binding, and internalisation of SST-$LH_N$/D. In contrast, GH3 cells lack suitable receptors for clostridial neurotoxins and are therefore not susceptible to botulinum neurotoxins (BoNTs).

FIG. 4 illustrates the inhibition of release of growth hormone (GH) from GH3 cells after prior incubation with SST-$LH_N$/D It is clear that dose-dependent inhibition is observed, indicating that SST-$LH_N$/D can inhibit the release of GH from a neuroendocrine cell model.

Comparison of the inhibition effects observed with conjugate and the untargeted $LH_N$/D demonstrate the contribution of the targeting moiety (TM) to efficient inhibition of transmitter release.

Materials and Methods

GH enzyme immunoassay kits were obtained from Millipore, Mass., USA. GH3 cells were cultured on 24 well plates in F-10 nutrient mixture (Ham) supplemented with 15% Horse Serum, 2.5% FBS, 2 mM L-Glutamine. Cells were treated with SST-$LH_N$/D or $LH_N$/D for 72 hours then the cells washed to remove unbound SST-$LH_N$/D. Secretion was stimulated by exposing the cells to 10 μM tetradecanoyl phorbol acetate (TPA, PMA) over 30 min. The medium was harvested from the cells and stored at −20° C. until assayed for GH content using the immunoassay kit and following the manufacturer's instructions. Stimulated secretion was calculated by subtracting basal release from total release under stimulating conditions.

Example 9

Method for Alleviating Acromegalic Symptoms by Reducing Elevated GH and IGF-1 Levels Resulting from Pituitary Adenoma A 35 year old male member of a regional badminton team undergoes a spinal X-ray for lower back pain. The consultant notices abnormal bone growth and, on questioning, the man reports increasing incidents of sleep apnoea and also increasingly oily skin.

The physician recommends measurement of circulating IGF-1 and these are found to be elevated. Subsequent tests also show above-normal circulating GH levels so a cranial MRI scan is carried out. This shows a pituitary tumour of 9 mm diameter. The patient is treated with a cortistatin or somatostatin peptide TM fusion protein (eg. SEQ ID 7-16, 18-24, 26-31) by i.v. injection.

At intervals of 1 week circulating IGF-1 levels are measured and are seen to be lower at the first measurement and to reduce steadily to 15% above normal over the following six weeks. The level of circulating GH is found to be normal at this time. A further dose of the medication with two-weekly IGF-1 measurements shows this hormone to have stabilised at the upper end of normal. At six weeks after the second treatment a cranial MRI scan reveals shrinkage of the tumour to 6 mm. The therapy is continued at a reduced dosage at two-monthly intervals with IGF-1 and GH levels measured on the seventh week. These are both stable in the normal range and the sleep apnoea and oily skin are now absent. A spinal X-ray at one year following the first treatment shows no increased bone size from the original observation.

Example 10

Method for Normalising Swollen Hirsute Fingers by Reducing Elevated GH and IGF-1 Levels Resulting from Pituitary Adenoma A 50 year old female confectionery worker has increasing difficulty removing her wedding ring and eventually visits her medical practitioner. The physician also notices the patient's fingers are hairier than expected and, on questioning, the patient admits that both these conditions have arisen gradually. Subsequent clinical tests reveal a higher-than-average level of circulating GH that does not change following a high-glucose drink. An acromegalic condition is suspected and a cranial CT scan confirms the presence of a small pituitary tumour.

Surgery is considered inappropriate so the patient is treated with an i.v. injection of a somatostatin or cortistatin peptide TM fusion protein (eg. SEQ ID 7-16, 18-24, 26-31). Within four weeks the glucose tolerance test shows a response in GH levels and IGF-1 levels are near normal. Treatment continues at six-weekly intervals and by the end of the eighteenth week the patient is able to remove her ring easily and the hirsutism has disappeared.

Example 11

Method for Ameliorating the Consequences of Re-Emerging Growth-Hormone-Secreting Pituitary Adenoma A 52 year-old male scuba diver presents with increasingly noticeable acromegalic symptoms, including soft tissue swelling and enlargement of the extremities. Thorough tests confirm the presence of a 12 mm pituitary adenoma. Somatostatin analogues are poorly tolerated by the patient so the tumour is resected and regular tests over 2 years show circulating GH and IGF-1 levels to be in the upper range of normal and no further medication is given. Eighteen months later, upon presenting with hyperhydrosis and moderate hypertension, GH and IGF-1 levels are found to be above normal and a CT scan reveals regrowth of the pituitary adenoma. Repeat resection is considered undesirable.

The man is treated by i.v. administration of a somatostatin or cortistatin peptide TM fusion protein (eg. SEQ ID 7-16, 18-24, 26-31). A course of radiotherapy is also given and after four weeks the hyperhydrosis and hypertension are near normal as are the GH and IGF-1 levels. Over the next three years symptoms do not recur and there is no tumour regrowth at five years post-treatment.

Example 12

Method for Treating Acromegalic Patients Resistant to Somatostatin Analogues

After six years' successful control of circulating GH and IGF-1 by somatostatin analogues, a 60-year-old acromegalic fairground tarot reader reports increasingly obvious oily skin and also prominent body odour as a result of hyperhydrosis. She is found to be glucose-intolerant and to have elevated circulating IGF-1 levels and raising the SSA dosage does not control these.

She is treated by localised injection of a somatostatin or cortistatin peptide TM fusion protein (eg. SEQ ID 7-16, 18-24, 26-31). Within 14 days the patient reports a significant reduction in sweating. Over the following month her oily skin returns to normal and at this time her GH and IGF-1 levels are both within the normal range. This situation remains over the next five years.

Example 13

Method for Treating Cushing's Disease in Patients Intolerant of Somatostatin Analogues A 30 year old female mature student visits her GP to request treatment for anxiety and depression. The physician observes the woman has a rounded face with increased fat around the neck and also thinner than normal arms and legs. Upon questioning she confirms an irregular menstrual cycle. A 24-hour urinary free cortisol level of 150 μg is measured suggesting Cushing's syndrome. Abdominal MRI scan shows no adrenal tumours to be present but cranial MRI scan reveals a small pituitary tumour.

The patient is considered unsuitable for surgical intervention so is treated with a somatostatin or cortistatin peptide TM fusion protein (eg. SEQ ID 7-16, 18-24, 26-31).

Example 14

Method for Reversing Female Sexual Impotence by Treating Prolactinoma

A 36 year old woman visits her doctor, worried about her recent expression of breast milk, despite her negative pregnancy test. Examination also indicates vaginal dryness and she confirms that she has lost her libido. Clinical test results are largely normal with the notable exception of moderate hyperprolactinaemia. A cranial MRI scan indicates a pituitary adenoma, consistent with the elevated prolactin levels.

She is treated by oral administration with a preparation of a somatostatin or cortistatin peptide TM fusion protein (eg. SEQ ID 7-16, 18-24, 26-31). After eight days she no longer expresses breast milk and her vaginal moisture levels have significantly improved. After seven weeks the dryness begins to return but is almost immediately reversed by a second treatment. Treatments continue at six-weekly visits to the sexual health clinic where the woman reports a return to normal sexual activity.

Example 15

Method for Bringing about Weight Loss by Treating Insulinoma

A 64 year old female with a BMI of 39 has been diagnosed with inoperable insulinoma. She wishes to achieve a sustained reduction in appetite and weight to enable her to maintain an active interest in aerobics so is treated by a systemic injection of a fusion protein comprising a somatostatin or cortistatin peptide TM (eg. SEQ ID 7-16, 18-24, 26-31). Within 10 to 14 days following treatment her weight gain has stabilised and by 30 days weight loss has occurred. The patient maintains a significant weight loss provided medication continues as a series of 24-weekly injections Example 16

Method for Treating Glucagonoma

A 63-year-old woman visits her doctor in a distressed state, having had rashes develop on her buttocks, around her groin and on her lower legs. Blood tests show her to be anaemic and diabetic. She also has frequent diarrhoeal episodes. The physician suspects the presence of glucagonoma and a CT scan confirms the existence of a tumour in the tail of the pancreas.

The patient is treated with a fusion protein comprising a somatostatin or cortistatin peptide TM (eg. SEQ ID 7-16, 18-24, 26-31). After 4 weeks the diarrhoeal episodes have subsided and the rashes have cleared significantly. Her red-cell count has also returned to near normal. The treatment is repeated at six-weekly intervals and the symptoms remain largely under control.

Example 17

Method for Treating Diarrhoea and Flushing Caused by VIPoma

A 49 year old man suffers from secretory diarrhoea associated with chronic flushing. Clinical tests indicate metabolic acidosis, and an abdominal CT scan reveals a tumour—almost certainly a VIPoma—near the pancreas.

Surgery is not available to the patient so he is treated with a fusion protein comprising a somatostatin or cortistatin peptide TM (eg. SEQ ID 7-16, 18-24, 26-31). Within 3 weeks the flushing has stopped and the diarrhoea has become less frequent. By seven weeks after treatment all symptoms have disappeared and remain absent providing therapy is repeated at approximately 8-week intervals.

Example 18

Method for Treating Gastrinoma

A 47-year-old man suffers from severe peptic ulceration that causes debilitating abdominal pain. He also experiences unexplained diarrhoeal episodes and eventually is diagnosed with intrapancreatic gastrinoma by blood tests and abdominal ultrasound study.

He is treated by intra-tumoural injection of a medication consisting of a fusion protein comprising a somatostatin or cortistatin peptide TM (eg. SEQ ID 7-16, 18-24, 26-31), or fusion comprising a GnRH peptide TM (eg. SEQ ID 93-94). Within a week painful gastric symptoms start to improve. The hypergastrinaemia has subsided and the diarrhoeal episodes have reduced in severity and frequency. This status pertains for 7 weeks but blood gastrin levels start to rise thereafter. The therapy is repeated at 7 week intervals and this maintains blood gastrin at normal levels and no other symptoms recur.

Example 19

Method for Treating Thyrotoxicosis Caused by Thyrotrophinoma

A 39-year-old female airline cabin crew member visits her physician complaining of excessive sweating, coupled with previously unknown nervousness, that have started to affect her ability to perform her job. During the consultation a fine tremor is evident and the doctor suspects thyrotoxicosis. The woman is referred to an endocrinologist who carries out a number of blood tests. The major abnormalities detected are elevated thyroxine levels but also elevated TSH (thyrotrophin) levels, indicative of a thyrotrophinoma. An MRI scan of the head confirms the presence of a pituitary tumour.

The woman is treated with a medication consisting of a fusion protein comprising somatostatin or cortistatin peptide TM (eg. SEQ ID 7-16, 18-24, 26-31). Both the sweating and nervousness decline over the following two weeks. Two-weekly follow-up blood tests show both thyroxine and thyrotrophin levels falling and they reach normal levels by six weeks. The patient is able to resume full employment activity.

Example 20

Method for Treating Recurrent Soft Tissue Swelling Caused by Acromegaly

A 72-year-old woman, having already had transsphenoidal surgery to remove a pituitary macroadenoma, shows recurrence of acromegalic symptoms (primarily swelling of fingers and tongue and increasing tiredness and lethargy). Cranial MRI scanning reveals the presence of a putative pituitary microadenoma and subsequent blood tests confirm elevated circulating GH and IGF-1 levels.

Surgery is deemed incompatible with pre-existing medical conditions so she is treated with a medication consisting of a fusion protein comprising a somatostatin or cortistatin peptide TM (eg. SEQ ID 7-16, 18-24, 26-31). After a week she reports feeling generally more active and that the swelling of her fingers and tongue has reduced noticeably. By three weeks the recurrent symptoms have reverted completely and endocrinological examination confirms a normalisation of GH and IGF-1 levels. She is monitored on a monthly basis and given repeat treatments at 10-weekly intervals. This dosage regimen keeps the hormone levels within the normal range and prevents recurrence of symptoms.

Example 21

Method for Treating Excessive Facial Hirsutism Caused by Cushing's Disease

A 27-rear-old beauty consultant starts to develop noticeable facial hair growth. This is not adequately treated by standard hair-removal methods and is causing her severe psychological problems (anxiety, depression) in relation to both her employment and her personal life. Her physician suspects Cushing's syndrome so she is referred to an endocrinologist. Blood and urine tests show elevated levels of Cortisol and ACTH levels, and a CRH stimulation test proves positive, confirming the likelihood of an ACTH-secreting pituitary tumour. Adrenal and pituitary CT-scans confirm the presence of a pituitary tumour but no adrenal abnormality.

Following discussions with consultants the patient opts for medical intervention and is treated with a medication consisting of a fusion protein comprising a somatostatin or cortistatin peptide TM (eg. SEQ ID 7-16, 18-24, 26-31), or fusion comprising a GnRH peptide TM (eg. SEQ ID 93-94). Within ten days the woman is starting to feel more positive and by the two week time point she has to use hair bleaching or depilatory creams with much lower frequency. The symptoms start to reappear at around ten to twelve weeks so a second treatment is given. A similar pattern of symptom remission, gradual reappearance and treatment occurs. During the third treatment, the patient elects for surgical removal of the pituitary tumour. Follow-up monitoring for the next two years shows no recurrence of symptoms or tumour.

Example 22

Method for Treating Male Galactorrhea Caused by Prolactinoma

A 40-year-old male rugby player has been worried for some time about increasing breast size beyond that expected from training. He becomes highly stressed when a trickle of milk appears at the left breast. His physician immediately suspects the existence of a pituitary prolactinoma and refers him to a radiologist and endocrinologist. Blood tests show hyperprolactinaemia but normal thyroid function. A cranial MRI scan shows a pituitary tumour to be present.

In the absence of any tumour-mass effect the man is treated with a medication consisting of a fusion protein comprising a somatostatin or cortistatin peptide TM (eg. SEQ ID 7-16, 18-24, 26-31). After only four days the milk expression has ceased and after six weeks there has been a measurable reduction in non-muscle breast tissue. During this period the blood prolactin levels were measured fortnightly and had returned to normal by the four-week measurement. The treatment is repeated at 12-week intervals during which time there is no recurrence of symptoms and no indication of tumour growth. Surgery or other tumour-reduction treatment is considered unnecessary while these conditions pertain.

Example 23

Method for Treating Multiple Symptoms Caused by Insulinoma

A 51-year-old man is diagnosed with insulinoma after presenting to the doctor with a variety of recently occurring conditions including blurred vision, palpitations, weakness, amnesia and, on two occasions in three months has passed out. The diagnosis is confirmed by endocrinological and radiographic tests.

He is treated with a medication consisting of a fusion protein comprising a somatostatin or cortistatin peptide TM (eg. SEQ ID 7-16, 18-24, 26-31), or fusion comprising a GnRH peptide TM (eg. SEQ ID 93-94). Within a week his vision and energy levels have returned to near normal and continue to improve over the following fortnight. At four weeks he is no longer hypoglycaemic and at that point laparoscopic enucleation of a pancreatic head tumour is performed. Subsequent patient monitoring records no return of symptoms or tumour mass and the patient remains healthy after three years.

Example 24

Method for Treating Acromegalic Patients Resistant to Somatostatin Analogues

After 3 years' successful control of circulating GH and IGF-1 by somatostatin analogues, a 54-year-old acromegalic office worker reports increasingly obvious oily skin and also prominent body odour as a result of hyperhydrosis. She is found to be glucose-intolerant and to have elevated circulating IGF-1 levels and raising the SSA dosage does not control these.

She is treated by intravenous injection of a fusion protein comprising a growth hormone releasing hormone peptide TM (eg. SEQ ID 34, 42-47, 60-92, 95-111). Within 14 days the patient reports a significant reduction in sweating. Over the following month her oily skin returns to normal and at this time her GH and IGF-1 levels are both within the normal range. This situation remains over the next five years.

Example 25

Method for Treating Cushing's Disease in Patients Intolerant of Somatostatin Analogues A 37 year old female receptionist visits her GP to request treatment for anxiety and depression. The physician observes the woman has a rounded face with increased fat around the neck and also thinner than normal arms and legs. Upon questioning she confirms an irregular menstrual cycle. A 24-hour urinary free cortisol level of 150 µg is measured suggesting Cushing's syndrome. Abdominal MRI scan shows no adrenal tumours to be present but cranial MRI scan reveals a small pituitary tumour.

The patient is considered unsuitable for surgical intervention so is treated with an intravenous injection of fusion protein comprising a urotensin peptide TM (eg. SEQ ID 48).

Example 26

Method for Reversing Female Sexual Impotence by Treating Prolactinoma

A 28 year old woman visits her doctor, worried about her recent expression of breast milk, despite her negative pregnancy test. Examination also indicates vaginal dryness and she confirms that she has lost her libido. Clinical test results are largely normal with the notable exception of moderate hyperprolactinaemia. A cranial MRI scan indicates a pituitary adenoma, consistent with the elevated prolactin levels.

She is treated by an intravenous injection of a fusion protein comprising a ghrelin peptide (GHRP) TM (eg. SEQ ID 33, 35, 38), or fusion comprising a GnRH peptide TM (eg. SEQ ID 93-94). After four days she no longer expresses breast milk and her vaginal moisture levels have significantly improved. After thirteen weeks the dryness begins to return but is almost immediately reversed by a second treatment. Treatments continue at twelve-weekly visits to the sexual health clinic where the woman reports a return to normal sexual activity.

Example 27

Method for Treating Cushing's Disease

A 30 year old female typist visits her GP to request treatment for anxiety and depression. The physician observes the woman has a rounded face with increased fat around the neck and also thinner than normal arms and legs. Upon questioning she confirms an irregular menstrual cycle. A 24-hour urinary free Cortisol level of 200 µg is measured suggesting Cushing's syndrome. Abdominal MRI scan shows no adrenal tumours to be present but cranial MRI scan reveals a small pituitary tumour.

The patient is considered unsuitable for surgical intervention so is treated with a fusion protein comprising a bombesin peptide (GRP) TM (eg. SEQ ID 40-41), or fusion comprising a GnRH peptide TM (eg. SEQ ID 93-94).

Example 28

Method for Treating Gastrinoma

A 63-year-old man suffers from severe peptic ulceration that causes debilitating abdominal pain. He also experiences unexplained diarrhoeal episodes and eventually is diagnosed with intrapancreatic gastrinoma by blood tests and abdominal ultrasound study.

He is treated by intra-tumoural injection of a medication consisting of a fusion protein comprising a somatostatin or cortistatin peptide TM analogue (octreotide—SEQ ID 54), which has been chemically conjugated to the protease-translocation protein (eg. SEQ ID 49-53). Within a week painful gastric symptoms start to improve. The hypergastrinaemia has subsided and the diarrhoeal episodes have reduced in severity and frequency. This status pertains for 8 weeks but blood gastrin levels start to rise thereafter. The therapy is repeated at 8 week intervals and this maintains blood gastrin at normal levels and no other symptoms recur.

Example 29

Method for Alleviating Acromegalic Symptoms by Reducing Elevated GH and IGF-1 Levels Resulting from Pituitary Adenoma A 50 year old female reports to her GP increasing incidents of sleep apnoea and also increasingly oily skin and the GP observes abnormal bone growth.

The GP recommends measurement of circulating IGF-1 and these are found to be elevated. Subsequent tests also show above-normal circulating GH levels so a cranial MRI scan is carried out. This shows a pituitary tumour of 5 mm diameter. The patient is treated with a MCH fusion protein (eg. SEQ ID 57) by i.v. injection.

At intervals of 1 week circulating IGF-1 levels are measured and are seen to be lower at the first measurement and to reduce steadily to 5% above normal over the following eight weeks. The level of circulating GH is found to be normal at this time. A further dose of the medication with two-weekly IGF-1 measurements shows this hormone to have stabilised at the upper end of normal. At six weeks after the second treatment a cranial MRI scan reveals shrinkage of the tumour to 3 mm. The therapy is continued at a reduced dosage at two-monthly intervals with IGF-1 and GH levels measured on the seventh week. These are both stable in the normal range and the sleep apnoea and oily skin are now absent.

Example 30

Method for Treating Acromegalic Patients Resistant to Somatostatin Analogues After 1 years' successful control of circulating GH and IGF-1 by somatostatin analogues, a 40-year-old acromegalic digger driver reports increasingly obvious oily skin and also prominent body odour as a result of hyperhydrosis. He is found to be glucose-intolerant and to have elevated circulating IGF-1 levels and raising the SSA dosage does not control these.

He is treated by intravenous injection of a fusion protein comprising a KISS1R binding peptide TM (eg. SEQ ID 58), or fusion comprising a GnRH peptide TM (eg. SEQ ID 93-94). Within 14 days the patient reports a significant reduction in sweating. Over the following month his oily skin returns to normal and at this time her GH and IGF-1 levels are both within the normal range. This situation remains over the next five years.

Example 31

Method for Treating Acromegaly

A patient reports to her GP that she can no longer fit into her size 8 shoes, a size she have worn for the past 25 years, and that her wedding ring will no longer fit. After ruling out obesity, the GP suspects this could be the result of a pituitary disorder the GP refers the patient for tests which confirm significantly elevated IGF-1 and GH levels. A cranial MRI confirms the presence of a pituitary adenoma.

She is treated by intravenous injection of a fusion protein comprising a prolactin releasing hormone receptor binding peptide TM (eg. SEQ ID 59). Over the following months GH and IGF-1 levels return to normal and this is maintained by a quarterly injection on the fusion protein.

Example 32

Activity of CP-GHRH-LHD on Rat IGF-1 Levels in vivo

Aims

To assess the impact of i.v. administration of CP-GHRH-LHD fusion on IGF-1 levels in rats five days after treatment compared with vehicle only treated control.

Materials and Methods

Animals: Adult male Sprague-Dawley rats maintained under standard housing conditions with lights on at 05.00 h (14L:10D), food and water available ad libitum and habituated to housing conditions for at least 1 week prior to surgery.

Surgery: On day 1 of the study rats (200-250 g) will be anaesthetised with a combination of Hypnorm (0.32 mg/kg fentanyl citrate and 10 mg/kg fluanisone, i.m.) and diazepam (2.6 mg/kg i.p.). The right jugular vein is exposed and a silastic tipped (i.d. 0.50 mm, o.d. 0.93 mm) polythene cannula (Portex, UK) inserted into the vessel until it lies close to the entrance of the right atrium. Cannulae will be prefilled with heparinised (10 IU/ml) isotonic saline. The free end of the cannulae will be exteriorised through a scalp incision and then tunnelled through a protective spring anchored to the skull using two stainless steel screws and self-curing dental acrylic. Following recovery animals are housed in individual cages in the automated blood sampling room. The end of the protective spring is attached to a mechanical swivel that allows the animal maximum freedom of movement. Cannulae are flushed daily with heparinised saline to maintain patency.

Treatment: At 09:00 on day 2 of the study rats will receive in i.v. injection of CP-GHRH-LHD or vehicle only control.

Sampling: The automated blood-sampling system (ABS) has been previously described (Clark et al., 1986; Windle et al., 1997). Three to four days after surgery the jugular vein cannula of each animal will be connected to the automated blood-sampling system. At 07:00 on day 6 sampling will begin. Blood samples will be collected at 10 minute intervals using the automated system for a 24 hour period. A total of 144 blood samples will be collected for each will contain no more than 38 μl of whole blood.

Results

The IGF-1 levels were measure using an IGF-1 ELISA kit. FIG. 5 illustrates a statistically significant reduction in the IGF-1 levels in the fusion treated rats compared to the vehicle only control with a t-test P value=0.0416 after only five days.

Example 33

Activity of CP-GHRH-LHD on Rat IGF-1 Levels in vivo

Aims:

This study is designed to investigate the activity timecourse for CP-GHRH-LHD fusion identifying the time delay between administration and initall effect of the compound in IGF-1 levels.

Materials and Methods:

Animals: Adult male Sprague-Dawley rats maintained under standard housing conditions with lights on at 05.00 h (14L:10D), food and water available ad libitum and habituated to housing conditions for at least 1 week prior to surgery.

Surgery: On day 1 of the study rats (260-280 g) will be anaesthetised with a combination of Hypnorm and diazepam. The right jugular vein is then exposed and a silastic tipped (i.d. 0.50 mm, o.d. 0.93 mm) polythene cannula (Portex, UK) inserted into the vessel until it lies close to the entrance of the right. Cannulae will be prefilled with heparinised (10 IU/ml) isotonic saline. The free end of the cannulae will be exteriorised through a scalp incision and passed through a spring anchored to the skull using stainless steel screws and dental cement. Following recovery animals will be housed in individual cages in the ABS room. The spring will be attached to a swivel that allows the animal maximum freedom of movement. Cannulae will be flushed daily with heparinised saline to maintain patency.

Treatment: At 10:00 h on day 5 of the study rats will receive in i.v. injection of the CP-GHRH-LHD or vehicle (sterile saline).

Blood sampling: After flushing the cannulae a single manual blood sample (100 μl) will be taken from each rat at 09.30 h. Samples will be taken from day 5 to day 18 of the experiment (or until the cannulae block). Plasma from blood samples will be stored at −20 C for later analysis of IGF-1 content by ELISA kit.

Results

FIG. 6 illustrates a statistically significant reduction in the IGF-1 levels in the fusion treated rats compared to the vehicle only control from day four after treatment.

Example 34

Activity of CP-GHRH-LHD on Rat Growth Hormone Levels in vivo

Aims

To assess the impact of i.v. administration of CP-GHRH-LHD fusion on growth hormone levels in rats five days after treatment compared with vehicle only treated and Octreotide infusion controls.

Materials and Methods

Animals: Adult male Sprague-Dawley rats maintained under standard housing conditions with lights on at 05.00 h (14L10D), food and water available ad libitum and habituated to housing conditions for at least 1 week prior to surgery.

Surgery: On day 1 of the study rats (200-250 g) will be anaesthetised with a combination of Hypnorm (0.32 mg/kg fentanyl citrate and 10 mg/kg fluanisone, i.m.) and diazepam (2.6 mg/kg i.p.). The right jugular vein is exposed and a silastic tipped (i.d. 0.50 mm, o.d. 0.93 mm) polythene cannula (Portex, UK) inserted into the vessel until it lies close to the entrance of the right atrium. Cannulae will be prefilled with heparinised (10 IU/ml) isotonic saline. The free end of the cannulae will be exteriorised through a scalp incision and then tunnelled through a protective spring anchored to the skull using two stainless steel screws and self-curing dental acrylic. Following recovery animals are housed in individual cages in the automated blood sampling room. The end of the protective spring is attached to a mechanical swivel that allows the animal maximum freedom of movement. Cannulae are flushed daily with heparinised saline to maintain patency.

Treatment: At 09:00 on day 2 of the study rats will receive in i.v. injection of the Syntaxin active compound or vehicle. A 12 hour infusion of somatostatin (or an analogue) will begin 6 hours after the start of sampling (administered via one of the dual cannulae lines) and will continue for 12 hours only. [This infusion timing should be an excellent GH assay control as we should see baseline secretion then complete inhibition and then rapid recovery/rebound]

Sampling: The automated blood-sampling system (ABS) has been previously described (Clark et al., 1986; Windle et al., 1997). Three to four days after surgery the jugular vein cannula of each animal will be connected to the automated blood-sampling system. At 07:00 on day 6 sampling will begin. Blood samples will be collected at 10 minute intervals using the automated system for a 24 hour period. A total of 144 blood samples will be collected for each will contain no more than 38 μl of whole blood.

Results

The growth hormone levels were measure using an RIA assay. FIG. 7*a* illustrates the vehical treated animals which show typical pulsatile release of growth hormone, FIG. 7*b* illustrates the complete ablation of the pulsatile growth hormone release after treatment with GHRH-LHD chimera and FIG. 7*c* shows the blocking of the pulsatile growth hormone release and subsequent recovery when the Octreotide infusion is stopped.

Example 35

Method for Alleviating Acromegalic Symptoms by Reducing Elevated GH and IGF-1 Levels Resulting from Pituitary Adenoma A 35 year old male member of a regional badminton team undergoes a spinal X-ray for lower back pain. The consultant notices abnormal bone growth and, on questioning, the man reports increasing incidents of sleep apnoea and also increasingly oily skin.

The physician recommends measurement of circulating IGF-1 and these are found to be elevated. Subsequent tests also show above-normal circulating GH levels so a cranial MRI scan is carried out. This shows a pituitary tumour of 9 mm diameter. The patient is treated with a GHRH peptide TM fusion protein (eg. SEQ ID 34, 42-47, 60-92, 95-111) by i.v. injection.

At intervals of 1 week circulating IGF-1 levels are measured and are seen to be lower at the first measurement and to reduce steadily to 15% above normal over the following six weeks. The level of circulating GH is found to be normal at this time. A further dose of the medication with two-weekly IGF-1 measurements shows this hormone to have stabilised at the upper end of normal. At six weeks after the second treatment a cranial MRI scan reveals shrinkage of the tumour to 6 mm. The therapy is continued at a reduced dosage at two-monthly intervals with IGF-1 and GH levels measured on the seventh week. These are both stable in the normal range and the sleep apnoea and oily skin are now absent. A spinal X-ray at one year following the first treatment shows no increased bone size from the original observation.

Example 36

Method for Treating Acromegaly

A patient reports to her GP that she can no longer fit into her size 8 shoes, a size she have worn for the past 25 years, and that her wedding ring will no longer fit. After ruling out obesity, the GP suspects this could be the result of a pituitary disorder the GP refers the patient for tests which confirm significantly elevated IGF-1 and GH levels. A cranial MRI confirms the presence of a pituitary adenoma.

She is treated by intravenous injection of a fusion protein comprising a GHRH peptide TM (eg. SEQ ID 34, 42-47, 60-92, 95-111). Over the following months GH and IGF-1 levels return to normal and this is maintained by a quarterly injection of the fusion protein.

Example 37

Method for Treating Cushing's Disease in Patients Intolerant of Somatostatin Analogues A 37 year old female receptionist visits her GP to request treatment for anxiety and depression. The physician observes the woman has a rounded face with increased fat around the neck and also thinner than normal arms and legs. Upon questioning she confirms an irregular menstrual cycle. A 24-hour urinary free Cortisol level of 150 μg is measured suggesting Cushing's syndrome. Abdominal MRI scan shows no adrenal tumours to be present but cranial MRI scan reveals a small pituitary tumour.

The patient is considered unsuitable for surgical intervention so is treated with an intravenous injection of fusion protein comprising a GHRH peptide TM (eg. SEQ ID 34, 42-47, 60-92, 95-111).

Example 38

Method for Treating Cushing's Disease

A 30 year old female typist visits her GP to request treatment for anxiety and depression. The physician observes the woman has a rounded face with increased fat around the neck and also thinner than normal arms and legs. Upon questioning she confirms an irregular menstrual cycle. A 24-hour urinary free Cortisol level of 200 μg is measured suggesting Cushing's syndrome. Abdominal MRI scan shows no adrenal tumours to be present but cranial MRI scan reveals a small pituitary tumour.

The patient is considered unsuitable for surgical intervention so is treated with a fusion protein comprising a GHRH peptide (GRP) TM (eg. SEQ ID 34, 42-47, 60-92, 95-111.

SEQUENCE LISTING (112 sequences)

SEQ ID NO: 1 - DNA, 2611 bp, Artificial Sequence
  source: /note="Description of Artificial Sequence: Synthetic polynucleotide"
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtctgagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaaaacaaagcgctgaacctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccacttaataagctt

SEQ ID NO: 2 - DNA, 2635 bp, Artificial Sequence
  source: /note="Description of Artificial Sequence: Synthetic polynucleotide"
ggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcgtcgacggcatcattacctccaaaactaaatctgacgatgacgataaaaacaaagcgctgaacctgcagtgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaactcttaataagctt

SEQ ID NO: 3 - DNA, 2614 bp, Artificial Sequence
  source: /note="Description of Artificial Sequence: Synthetic polynucleotide"
ggatccatgccgatcaccatcaacaacttcaactacagcgatccggtggataacaaaaacatcctgtacctggatacccatctgaataccctggcgaacgaaccggaaaaagcgtttcgtatcaccggcaacatttgggttattccggatcgttttagccgtaacagcaacccgaatctgaataaaccgccgcgtgttaccagcccgaaaagcggttattacgatccgaactatctgagcaccgatagcgataaagataccttcctgaaagaaatcatcaaactgttcaaacgcatcaacagccgtgaaattggcgaagaactgatctatcgcctgagcaccgatattccgtttccgggcaacaacaacaccccgatcaacacctttgatttcgatgtggatttcaacagcgttgatgttaaaacccgccagggtaacaattgggtgaaaaccggcagcattaacccgagcgtgattattaccggtccgcgcgaaaacattattgatccggaaaccagcacctttaaactgaccaacaacacctttgcggcgcaggaaggttttggcgcgctgagcattattagcattagcccgcgctttatgctgacctatagcaacgcgaccaacgatgttggtgaaggccgtttcagcaaaagcgaattttgcatggacccgatcctgatcctgatgcatgaactgaaccatgcgatgcataacctgtatggcatcgcgattccgaacgatcagaccattagcagcgtgaccagcaacatcttttacagccagtacaacgtgaaactggaatatgcggaaatctatgcgtttggcggtccgaccattgatctgattccgaaaagcgcgcgcaaatacttcgaagaaaaagcgctggattactatcgcagcattgcgaaacgtctgaacagcattaccaccgcgaatccgagcagcttcaacaaatatatcggcgaatataaacagaaactgatccgcaaatatcgctttgtggtggaaagcagcggcgaagttaccgttaaccgcaataaattcgtggaactgtacaacgaactgacccagatcttcaccgaatttaactatgcgaaaatctataacgtgcagaaccgtaaaatctacctgagcaacgtgtataccccggtgaccgcgaatattctggatgataacgtgtacgatatccagaacggctttaacatcccgaaaagcaacctgaacgttctgtttatgggccagaacctgagccgtaatccggcgctgcgtaaagtgaacccggaaaacatgctgtacctgttcaccaaattttgcgtcgacgcgattgatggtcgtagcctgtacaacaaaaccctgcagtgtcgtgaactgctggtgaaaaacaccgatctgccgtttattggcgatatcagcgatgtgaaaaccgatatcttcctgcgcaaagatatcaacgaagaaaccgaagtgatctactacccggataacgtgagcgttgatcaggtgatcctgagcaaaaacaccagcgaacatggtcagctggatctgctgtatccgagcattgatagcgaaagcgaaattctgccgggcgaaaaccaggtgttttacgataaccgtacccagaacgtggattacctgaacagctattactacctggaaagccagaaactgagcgataacgtggaagattttacctttacccgcagcattgaagaagcgctggataacagcgcgaaagtttacacctattttccgaccctggcgaacaaagttaatgcgggtgttcagggcggtctgtttctgatgtgggcgaacgatgtggtggaagatttcaccaccaacatcctgcgtaaagataccctggataaaatcagcgatgttagcgcgattattccgtatattggtccggcgctgaacattagcaatagcgtgcgtcgtggcaattttaccgaagcgtttgcggttaccggtgtgaccattctgctggaagcgtttccggaatttaccattccggcgctgggtgcgtttgtgatctatagcaaagtgcaggaacgcaacgaaatcatcaaaaccatcgataactgcctggaacagcgtattaaacgctggaaagatagctatgaatggatgatgggcacctggctgagccgtattatcacccagttcaacaacatcagctaccagatgtacgatagcctgaactatcaggcgggtgcgattaaagcgaaaatcgatctggaatacaaaaaatacagcggcagcgataaagaaaacatcaaaagccaggttgaaaacctgaaaaacagcctggatgtgaaaattagcgaagcgatgaataacatcaacaaattcatccgcgaatgcagcgtgacctacctgttcaaaaacatgctgccgaaagtgatcgatgaactgaacgaatttgatcgcaacaccaaagcgaaactgatcaacctgatcgatagccacaacattattctggtgggcgaagtggataaactgaaagcgaaagttaacaacagcttccagaacaccatcccgtttaacatcttcagctataccaacaacagcctgctgaaagatatcatcaacgaatacttcaattaataagctt

SEQ ID NO: 4 - DNA, 2632 bp, Artificial Sequence
  source: /note="Description of Artificial Sequence: Synthetic polynucleotide"
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgacaaaagcgaagagaagctgtacgatgacgatgacaaagatcgttggggatcgtccctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaattaataagctt

SEQ ID NO: 5 - DNA, 240 bp, Artificial Sequence
  source: /note="Description of Artificial Sequence: Synthetic polynucleotide"
catatgggatccggtttaaacgtcgacggcatcattacctccaaaactaaatctgacgatgacgataaaagcgccaattcaaatcctgcaatggcgccacgcgaacgcaaagctggttgcaaaaacttcttctggaaaaccttcacctcttgcgcgctagcgggcggtggcggtagcggcggtggcggtagcggcggtggcggtagcgcactagtgctgcagctagaataatgaaagctt

SEQ ID NO: 6 - DNA, 195 bp, Artificial Sequence
  source: /note="Description of Artificial Sequence: Synthetic polynucleotide"
ggatccgtcgacctgcagggtctagaaggcggtggcggtagcggcggtggcggtagcggcggtggcggtagcggcggtggcggtagcgcactagtgcaggaaagacctccattacaacaacctccacatcgcgataagaaaccatgtaagaatttcttttggaaaacatttagcagttgcaaatgataaaagctt

SEQ ID NO: 7 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKPCKNFFWKTFSSCKALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 8 - protein, 912 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKPCKNFFWKTFSSCKALAGGGGSGGGGSGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 9 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKQERPPLQQPPHRDKKPCKNFFWKTFSSCKALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 10 - protein, 927 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKQERPPLQQPPHRDKKPCKNFFWKTFSSCKALAGGGGSGGGGSGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 11 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKAGCKNFFWKTFTSCALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 12 - protein, 912 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKAGCKNFFWKTFTSCALAGGGGSGGGGSGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 13 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKSANSNPAMAPRERKAGCKNFFWKTFTSCALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 14 - protein, 926 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKSANSNPAMAPRERKAGCKNFFWKTFTSCALAGGGGSGGGGSGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 15 - protein, 905 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVPCKNFFWKTFSSCK

SEQ ID NO: 16 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSGGGGSALVPCKNFFWKTFSSCK

SEQ ID NO: 17 - DNA, 2779 bp, Artificial Sequence
  source: /note="Description of Artificial Sequence: Synthetic polynucleotide"
ggatccatgacgtggccagttaaggatttcaactactcagatcctgtaaatgacaacgatattctgtaccttcgcattccacaaaataaactgatcaccacaccagtcaaagcattcatgattactcaaaacatttgggtcattccagaacgcttttctagtgacacaaatccgagtttatctaaacctccgcgtccgacgtccaaatatcagagctattacgatccctcatatctcagtacggacgaacaaaaagatactttccttaaaggtatcattaaactgtttaagcgtattaatgagcgcgatatcgggaaaaagttgattaattatcttgttgtgggttccccgttcatgggcgatagctctacccccgaagacacttttgattttacccgtcatacgacaaacatcgcggtagagaagtttgagaacggatcgtggaaagtcacaaacatcattacacctagcgtcttaatttttggtccgctgccaaacatcttagattatacagccagcctgactttgcaggggcaacagtcgaatccgagtttcgaaggttttggtaccctgagcattctgaaagttgccccggaatttctgctcactttttcagatgtcaccagcaaccagagctcagcagtattaggaaagtcaattttttgcatggacccggttattgcactgatgcacgaactgacgcactctctgcatcaactgtatgggatcaacatccccagtgacaaacgtattcgtccccaggtgtctgaaggatttttctcacaggatgggccgaacgtccagttcgaagagttgtatactttcggaggcctggacgtagagatcattccccagattgagcgcagtcagctgcgtgagaaggcattgggccattataaggatattgcaaaacgcctgaataacattaacaaaacgattccatcttcgtggatctcgaatattgataaatataagaaaatttttagcgagaaatataattttgataaagataatacaggtaactttgtggttaacattgacaaattcaactccctttacagtgatttgacgaatgtaatgagcgaagttgtgtatagttcccaatacaacgttaagaatcgtacccattacttctctcgtcactacctgccggttttcgcgaacatccttgacgataatatttacactattcgtgacggctttaacttgaccaacaagggcttcaatattgaaaattcaggccagaacattgaacgcaacccggccttgcagaaactgtcgagtgaatccgtggttgacctgtttaccaaagtctgcgtcgacaaaagcgaagagaagctgtacgatgacgatgacaaagatcgttggggatcgtccctgcagtgtattaaagtgaaaaacaatcggctgccttatgtagcagataaagatagcattagtcaggagattttcgaaaataaaattatcactgacgaaaccaatgttcagaattattcagataaattttcactggacgaaagcatcttagatggccaagttccgattaacccggaaattgttgatccgttactgccgaacgtgaatatggaaccgttaaacctccctggcgaagagatcgtattttatgatgacattacgaaatatgtggactaccttaattcttattactatttggaaagccagaaactgtccaataacgtggaaaacattactctgaccacaagcgtggaagaggctttaggctactcaaataagatttataccttcctcccgtcgctggcggaaaaagtaaataaaggtgtgcaggctggtctgttcctcaactgggcgaatgaagttgtcgaagactttaccacgaatattatgaaaaaggataccctggataaaatctccgacgtctcggttattatcccatatattggccctgcgttaaatatcggtaatagtgcgctgcgggggaattttaaccaggcctttgctaccgcgggcgtcgcgttcctcctggagggctttcctgaatttactatcccggcgctcggtgtttttacattttactcttccatccaggagcgtgagaaaattatcaaaaccatcgaaaactgcctggagcagcgggtgaaacgctggaaagattcttatcaatggatggtgtcaaactggttatctcgcatcacgacccaattcaaccatattaattaccagatgtatgatagtctgtcgtaccaagctgacgccattaaagccaaaattgatctggaatataaaaagtactctggtagcgataaggagaacatcaaaagccaggtggagaaccttaagaatagtctggatgtgaaaatctctgaagctatgaataacattaacaaattcattcgtgaatgttcggtgacgtacctgttcaagaatatgctgccaaaagttattgatgaactgaataaatttgatctgcgtaccaaaaccgaacttatcaacctcatcgactcccacaacattatccttgtgggcgaagtggatcgtctgaaggccaaagtaaacgagagctttgaaaatacgatgccgtttaatattttttcatataccaataactccttgctgaaagatatcatcaatgaatatttcaatctagaaggcggtggcggtagcggcggtggcggtagcggcggtggcggtagcgcactagtgcaggaaagacctccattacaacaacctccacatcgcgataagaaaccatgtaagaatttcttttggaaaacatttagcagttgcaaataataagctt

SEQ ID NO: 18 - protein, 920 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVQERPPLQQPPHRDKKPCKNFFWKTFSSCK

SEQ ID NO: 19 - protein, 930 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSGGGGSALVQERPPLQQPPHRDKKPCKNFFWKTFSSCK

SEQ ID NO: 20 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSIDGRNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYIDGRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVAGCKNFFWKTFTSC

SEQ ID NO: 21 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSGGGGSALVAGCKNFFWKTFTSC

SEQ ID NO: 22 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVSANSNPAMAPRERKAGCKNFFWKTFTSC

SEQ ID NO: 23 - protein, 929 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSGGGGSALVSANSNPAMAPRERKAGCKNFFWKTFTSC

SEQ ID NO: 24 - protein, 919 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSGGGGSGGGGSGGGGSGGGGSALVAGCKNFFWKTFTSC

SEQ ID NO: 25 - DNA, 2743 bp, Artificial Sequence
  source: /note="Description of Artificial Sequence: Synthetic polynucleotide"
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtctgagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagttagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctccagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtcgacggcatcattacctccaaaactaaatctgacgatgacgataaaagcgccaattcaaatcctgcaatggcgccacgcgaacgcaaagctggatgcaaaaacttcttttggaagacatttactagttgtgcgctagcgggcggtggcggtagcggcggtggcggtagcggcggtggcggtagcgcactagtgctgcagtgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggcgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtccacttaataagctt

SEQ ID NO: 26 - protein, 908 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECLSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKSANSNPAMAPRERKAGCKNFFWKTFTSCALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 27 - protein, 920 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKNKALNLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEGGGGSGGGGSGGGGSALDSANSNPAMAPRERKAGCKNFFWKTFTSC

SEQ ID NO: 28 - protein, 904 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSGGGGSALVAGCKNFFWKTFTSC

SEQ ID NO: 29 - protein, 912 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSGGGGSGGGGSALVDRMPCRNFFWKTFSSCK

SEQ ID NO: 30 - protein, 913 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECLSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVQEGAPPQQSARRDRMPCRNFFWKTFSSCK

SEQ ID NO: 31 - protein, 936 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDGIITSKTKSDDDDKNKALNLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEGGGGSGGGGSGGGGSGGGGSGGGGSGGGGSALDQEGAPPQQSARRDRMPCRNFFWKTFSSCK

SEQ ID NO: 32 - DNA, 2065 bp, Artificial Sequence
  source: /note="Description of Artificial Sequence: Synthetic polynucleotide"
ggatccatggagtccaatcagccggaaaaaaatggaaccgcgactaaacccgagaattcggggaacactacgtcggaaaacggccagacggaacctgagaagaaactggaactacgaaatgtgtccgatatcgagctatactctcaaaccaatggaacctataggcagcatgtttcattggacggaatcccagaaaatacggatacatatttcgtcaaagtgaagtctagcgcattcaaggatgtatatatccccgttgcgagtattacagaagagaagcggaacggtcaaagcgtttataagattacagcaaaggccgaaaagttacaacaggagttagaaaacaaatacgttgacaatttcactttttatctcgataaaaaggctaaagaggaaaacacgaacttcacgtcatttagtaatctggtcaaagccataaatcaaaatccatctggtacataccatctcgcggcaagtctaaacgcgaatgaagtagaacttggcccggacgagcgttcatacattaaggatacctttactggcagactcataggggaaaaagacggtaagaactatgctatatacaatttgaaaaagcctttatttgagaacctgtcgggcgccaccgtcgagaaattgtcccttaaaaacgtagctataagcggaaagaatgacatcggtagtcttgcaaacgaggctactaacgggacaaagattaaacaagtgcacgtagatgggtgtgtcgacggcatcattacctccaaaactaaatctgacgatgacgataaaaacaaagcgctgaacctgcagtgcattaaaataaagaatgaggatttgacattcatcgcagaaaaaaatagcttcagcgaagagccgttccaagatgagatagtaagctacaacaccaagaacaagccgcttaattttaattactcgttagataaaatcatagttgactacaaccttcaatcgaagatcacgttaccgaatgacagaacaactcctgtcacaaaaggaattccctatgcacctgagtataagtcaaatgccgcgtcaacaatagagattcataatatagatgacaacaccatctatcaatatctgtacgctcagaaaagtccaacaactcttcagcgtataacaatgaccaatagtgtcgatgacgcattgataaattctaccaagatatactcttatttcccgagcgtcatctccaaagttaatcaaggtgctcaaggcattctatttttgcaatgggtccgagacatcatagatgacttcactaatgagtcgtctcagaaaaccacgattgataaaatatcagatgtttccaccatcgtcccctacatcggacctgcgcttaacattgtgaagcaggggtatgaggggaattttatcggagcgttagaaactacgggggttgtgctattacttgaatacataccagagataacattgcccgttatagcggccctcagtatcgcagaatcaagtacacaaaaagaaaagataatcaaaacaatcgacaacttcctagaaaagaggtacgaaaaatggatagaggtttataaactcgtgaaagcgaaatggttaggcactgttaatacgcagttccaaaagagatcctatcaaatgtatagatcactggagtaccaggtggatgccataaagaaaattatcgactatgaatataaaatatattcaggtccagataaggagcagatagctgatgaaataaacaatttaaaaaacaaacttgaagagaaggcgaataaggccatgatcaatatcaatatttttatgcgagaatcttcacgatcttttttggtaaatcagatgattaacgaagccaaaaagcagctgcttgagttcgacacacagtccaaaaacatactaatgcaatatatcaaagcaaactcaaaattcattggaattactgagctgaagaaactggaatccaaaataaataaagtattctctaccccgatcccgttctcttactctaaaaaccttgactgctgggtagataacgaagaagatattgacgttctagagtaataagctt

SEQ ID NO: 33 - protein, 913 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVGSSFLSPEHQRVQQRKESKKPPAKLQPR

SEQ ID NO: 34 - protein, 931 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVYADAIFTNSYRKVLGQLSARKLLQDIMSRQQGESNQERGA

SEQ ID NO: 35 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVGSSFLSPEHQRVQQRKESKKPPAKLQPR

SEQ ID NO: 36 - protein, 912 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVGSSFLSPEHQRVQQRKESKKPPAKLQPR

SEQ ID NO: 37 - protein, 714 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVLEGGGGSGGGGSGGGGSALVAGCKNFFWKTFTSC

SEQ ID NO: 38 - protein, 728 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVLEGGGGSGGGGSGGGGSALVGSSFLSPEHQRVQQRKESKKPPAKLQPR

SEQ ID NO: 39 - protein, 899 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEIYALVGSWFLSPEHQRVQQRKESKKPPAKLQPR

SEQ ID NO: 40 - protein, 901 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVGNHWAVGHLM

SEQ ID NO: 41 - protein, 899 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDEEKLYDDDDKDRWGSSLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSLEGGGGSGGGGSGGGGSALVGNHWAVGHLM

SEQ ID NO: 42 - protein, 909 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRAEAAAKEAAAKALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 43 - protein, 919 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSLIEGRHVDAIFTQSYRKVLAQLSARKLLQDILNRQQGERNQEQGALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 44 - protein, 919 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRHVDAIFTQSYRKVLAQLSARKLLQDILNRQQGERNQEQGALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 45 - protein, 928 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTQSYRKVLAQLSARKLLQDILNRQQGERNQEQGAALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 46 - protein, 913 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRQQGERNQEQGAPAPAPLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 47 - protein, 919 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDNNNNNNNNNNDDDDKHVDAIFTQSYRKVLAQLSARKLLQDILNRQQGERNQEQGAEAAAKEAAAKALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 48 - protein, 918 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGGGGSADDDDKNDDPPISIDLTFHLLRNMIEMARIENEREQAGLNRKYLDEVALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 49 - protein, 864 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 50 - protein, 869 aa, Artificial Sequence
  source: /note="Description of Artificial Sequence: Synthetic polypeptide"
PVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCVDEEKLYDDDDKDRWGSSLQCIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDAIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 51 - protein, 865 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 52 - protein, 871 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 53 - protein, 680 aa, Artificial Sequence
  source: /note="Description of Artificial Sequence: Synthetic polypeptide"
ESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELGPDERSYIKDTFTGRLIGEKDGKNYAIYNLKKPLFENLSGATVEKLSLKNVAISGKNDIGSLANEATNGTKIKQVHVDGCVDGIITSKTKSDDDDKNKALNLQCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDV

SEQ ID NO: 54 - protein, 9 aa, Artificial Sequence
  source: /note="Description of Artificial Sequence: Synthetic peptide"
  MOD_RES (2)..(2): D-Phe
  MOD_RES (5)..(5): D-Trp
  misc_feature (9)..(9): /note="C-terminal-alcohol"
CFCFWKTCT

SEQ ID NO: 55 - protein, 30 aa, Artificial Sequence
  source: /note="Description of Artificial Sequence: Synthetic polypeptide"
  MOD_RES (27)..(27): Norleucine
HADAIFTNSYRKVLGQLSARKLLQDILSRC

SEQ ID NO: 56 - protein, 30 aa, Artificial Sequence
  source: /note="Description of Artificial Sequence: Synthetic polypeptide"
  MOD_RES (1)..(1): PhAc-Tyr
  MOD_RES (2)..(2): D-Arg
  MOD_RES (6)..(6): Phe(4-Cl)
  MOD_RES (9)..(9): Homoarginine
  MOD_RES (10)..(10): Tyr(Me)
  MOD_RES (15)..(15): Alpha-aminobutyric acid
  MOD_RES (27)..(27): Norleucine
  MOD_RES (28)..(28): D-Arg
  MOD_RES (29)..(29): Homoarginine
YRDAIFTARYHKVLXQLSAHKLLQDILRRC

SEQ ID NO: 57 - protein, 893 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKDFDMLRCMLGRVYRPCWQVALAKRLVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 58 - protein, 902 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSALVYNWNSFGLRFG

SEQ ID NO: 59 - protein, 905 aa, Artificial Sequence
  source: /note="Description of Artificial Sequence: Synthetic polypeptide"
EFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVDGIITSKTKSDDDDKNKALNLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLEGGGGSGGGGSGGGGSALVTPDINPAWYASRGIRPVGRFG

SEQ ID NO: 60 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 61 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 62 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 63 - protein, 932 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRQQGESNQERGARARLALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 64 - protein, 927 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKLLQDIMSRQQGESNQERGALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 65 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNAYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 66 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLGQLSARKALQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 67 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 68 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKRVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 69 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYNKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 70 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSAKKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 71 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYKKVLGQLSAKKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 72 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSANKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 73 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRNVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 74 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSARNLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 75 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFEASYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 76 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASERKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 77 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKELGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 78 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 79 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTESYRKVLGQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 80 - protein, 915 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLAQLSARKLLQDIMALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 81 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTNSYRKVLAQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 82 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTASYRKVLAQLSARKLLQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 83 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTAAYRKVLAQLSARKALQDIASRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 84 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTAAYRKVLAQLSARKALQDIMSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 85 - protein, 920 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTQSYRKVLAQLSARKALQDILSRQQGALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 86 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTSSYRKVLAQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 87 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKHVDAIFTTSYRKVLAQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 88 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTQSYRKVLAQLSARKALQDILNRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 89 - protein, 917 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSDDDDKYADAIFTQSYRKVLAQLSARKALQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 90 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSIEGRYADAIFTASYRKVLGQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 91 - protein, 916 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSIEGRYADAIFTASYRNVLGQLSARKLLQDILSRALAGGGGSGGGGSGGGGSALALQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 92 - protein, 910 aa, Artificial Sequence
  source: /note="Description of Artificial Sequence: Synthetic polypeptide"
HVDAIFTQSYRKVLAQLSARKLLQDILNRNNNNNNNNNNTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFN

SEQ ID NO: 93 - protein, 977 aa, Artificial Sequence
  source: /note="Description of Artificial Sequence: Synthetic polypeptide"
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDAIDGRSLYNKTLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLEGGGGSGGGGSGGGGSALVMKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 94 - protein, 988 aa, Artificial Sequence
  source: /note="Description of Artificial Sequence: Synthetic polypeptide"
TWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDKSEEKLYDDDDKDRWGSSLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNLEGGGGSGGGGSGGGGSGGGGSALVMKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 95 - protein, 927 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNSYRKVLGQLSARKLLQDIMSRQQGESNQERGALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 96 - protein, 931 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNSYRKVLGQLSARKLLQDIMSRQQGESNQERGARARLLAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 97 - protein, 916 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNRYRKVLGQLSARKLLQDIMSRLAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 98 - protein, 916 aa, Artificial sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTARYRKVLGQLSARKLLQDIMSRLAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 99 - protein, 927 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNRYRKVLGQLSARKLLQDIMSRQQGESNQERGALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 100 - protein, 931 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNRYRKVLGQLSARKLLQDIMSRQQGESNQERGARARLLAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 101 - protein, 916 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTNSYRKVRRRRSARKLLQDIMSRLAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 102 - protein, 927 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRYADAIFTASYRKVLGQLSARKLLQDIMSRQQGESNQERGALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 103 - protein, 928 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNSYRKVLGQLSARKLLQDIMSRQQGESNQERGALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 104 - protein, 932 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNSYRKVLGQLSARKLLQDIMSRQQGESNQERGARARLLAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 105 - protein, 917 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNRYRKVLGQLSARKLLQDIMSRLAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 106 - protein, 917 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTARYRKVLGQLSARKLLQDIMSRLAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 107 - protein, 928 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNRYRKVLGQLSARKLLQDIMSRQQGESNQERGALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 108 - protein, 932 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNRYRKVLGQLSARKLLQDIMSRQQGESNQERGARARLLAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 109 - protein, 917 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTNSYRKVRRRRSARKLLQDIMSRLAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 110 - protein, 928 aa, Artificial Sequence
  Synthetic sequence
PITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCVDGIITSKTKSLIEGRYADAIFTASYRKVLGQLSARKLLQDIMSRQQGESNQERGALAGGGGSGGGGSGGGGSALVLQCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 111 - protein, 927 aa, Artificial Sequence
  Synthetic sequence
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCVDGIITSKTKSLIEGRHVDAIFTQSYRKVLAQLSARKLLQDILNRQQGERNQEQGALAGGGGSGGGGSGGGGSALVLQCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYF

SEQ ID NO: 112 - DNA, 2781 bp, Artificial Sequence
  Synthetic sequence
atgacctggccggtcaaagacttcaactatagcgatccggtcaacgacaacgatatcctgtatctgcgcattccgcagaacaaactgattaccacgccggtgaaagccttcatgattactcagaacatctgggtgatcccggaacgtttttcttccgatactaacccgtctctgtctaaaccgccgcgtccgacctccaaatatcagtcttactacgatccgtcttacctgtccaccgacgaacagaaagacacgtttctgaaaggcatcatcaaactgttcaaacgtatcaacgagcgtgacattggcaaaaaactgatcaactacctggtagtgggttctccgttcatgggtgattctagcactccggaagataccttcgacttcactcgccacaccactaacatcgcagtggaaaaattcgagaacggtagctggaaagtcaccaacatcatcactccgtctgttctgatctttggtccgctgccgaacattctggactatactgcatctctgaccctgcagggtcagcagagcaacccgtccttcgaaggcttcggtaccctgtctatcctgaaagttgcaccggaattcctgctgactttcagcgacgttacctctaaccagtcctctgcagtactgggtaaaagcattttctgcatggacccggttattgctctgatgcatgaactgacccacagcctgcaccagctgtatggtatcaacatcccgtctgataaacgcattcgtccgcaggtctctgaaggtttcttttctcaggatggcccgaacgttcagttcgaggaactgtatactttcggtggcctggatgttgaaatcattccgcagatcgaacgttctcagctgcgcgaaaaagcgctgggtcactacaaagatatcgcaaaacgcctgaacaacatcaacaaaacgattccgtccagctggatctccaacatcgataaatacaaaaaaatcttctccgagaaatacaacttcgataaagacaacactggcaacttcgtggtcaacatcgacaaattcaactctctgtacagcgacctgaccaacgttatgtccgaagtcgtttactcttcccagtacaacgtcaaaaaccgtacccactatttttctcgccactatctgccggtattcgcgaacattctggacgacaacatttacacgatccgcgatggcttcaacctgaccaacaaaggctttaacatcgagaacagcggtcagaacattgaacgtaacccggcactgcagaaactgtcctctgaatctgtggttgatctgtttaccaaagtatgcgtagacggcattatcacctccaaaaccaaatccctgattgaaggtcgccacgtggatgcgatcttcactcagtcttaccgtaaagttctggcgcagctgagcgctcgtaaactgctgcaggatatcctgaaccgtcagcagggtgaacgtaaccaggaacagggcgctctggctggtggcggtggctctggtggcggcggttctggcggcggtggttctgccctggtactgcagtgtatcaaagtgaaaaacaaccgtctgccgtacgttgccgataaagattctatctctcaggagatcttcgagaacaaaattatcaccgacgagaccaacgttcagaactacagcgacaaatttagcctggatgaatccatcctggatggtcaggtgccgatcaacccggaaatcgtagatccgctgctgccgaacgttaacatggaaccgctgaacctgccgggtgaggaaatcgtcttttacgatgacatcaccaaatacgtggactatctgaactcctattactacctggaatcccagaaactgtccaacaacgtcgaaaacattactctgactacgtctgttgaggaagccctgggctactctaacaaaatctacacgtttctgccgtccctggcggaaaaagtaaacaaaggtgttcaggcaggcctgtttctgaactgggctaacgaggttgtggaagatttcaccaccaacattatgaaaaaagacaccctggacaaaatctctgacgtatctgtgatcattccgtacatcggtccggctctgaacattggtaactctgctctgcgtggcaacttcaaccaggcgtttgctactgcaggcgtagctttcctgctggaaggttttccggagtttaccattccggccctgggtgttttcaccttctatagctccattcaggagcgtgagaaaatcattaaaaccatcgagaactgtctggaacagcgcgtgaaacgttggaaagattcttatcagtggatggtttctaactggctgtctcgtatcaccacgcagttcaaccatattaactaccagatgtacgatagcctgtcttaccaggcggacgctatcaaagcgaaaatcgacctggagtataaaaaatactctggcagcgacaaagaaaacatcaaaagccaggtggaaaacctgaaaaactccctggacgtgaaaatctccgaagcgatgaacaacatcaacaaatttatccgtgagtgcagcgtcacgtacctgttcaaaaacatgctgccgaaagtgatcgacgagctgaacaaatttgacctgcgcaccaaaaccgagctgatcaacctgattgattcccataacatcatcctggtaggtgaagttgaccgtctgaaagcgaaagttaacgaatctttcgaaaacactatgccgttcaacatttttagctataccaacaactctctgctgaaagacattatcaacgaatacttc

What is claimed is:

1. A polypeptide comprising the amino acid sequence of SEQ ID NOs: 95, 96, 97, 98, 99, 100, 101, 102, 103, 104, 105, 106, 107, 108, 109, 110 or 111.

2. A nucleic acid sequence encoding a polypeptide according to claim 1.

3. A nucleic acid sequence according to claim 2, wherein said sequence comprises the nucleic acid sequence of SEQ ID NO: 112.

4. A method for activating a polypeptide comprising:

(i) providing a polypeptide according to claim 1, said polypeptide comprising an amino acid sequence having an N-terminus and a C-terminus, wherein said amino acid sequence comprises in an N-terminus to C-terminus direction:

a) a clostridial neurotoxin L-chain amino acid sequence b) a site for cleavage by a proteolytic enzyme;

c) a GHRH amino acid sequence; and d) a clostridial neurotoxin $H_N$ translocation domain amino acid sequence;

(ii) contacting said polypeptide with a proteolytic enzyme that cleaves said cleavage site;

(iii) cleaving said polypeptide at said cleavage site, and thereby providing a di-chain polypeptide wherein the clostridial neurotoxin L-chain amino acid sequence and the clostridial neurotoxin $H_N$ translocation domain amino acid sequence are linked together by a disulphide bond.

5. A method according to claim 4, wherein the proteolytic enzyme is a factor Xa proteolytic enzyme.

6. A method for suppressing secretion from a neuroendocrine tumour cell, said method comprising administering to a patient a therapeutically effective amount of a polypeptide, wherein said polypeptide is a polypeptide according to claim 1.

7. A method according to claim 6, wherein said method suppresses Cushing's disease.

8. A method according to claim 6, wherein said method suppresses acromegaly.

* * * * *

UNITED STATES PATENT AND TRADEMARK OFFICE

CERTIFICATE OF CORRECTION

PATENT NO. : 8,796,216 B2
APPLICATION NO. : 12/969810
DATED : August 5, 2014
INVENTOR(S) : Johnstone et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 563 days.

Signed and Sealed this
First Day of September, 2015

Michelle K. Lee
*Director of the United States Patent and Trademark Office*